United States Patent 9,567,581 (SELECTIVE REACTIVATION OF GENES ON THE INACTIVE X CHROMOSOME) - sequence listing, part 12

SEQ ID NO: 1041 - DNA, 4990667 bp, mus musculus (residues 3,327,113-4,990,667 of 4,990,667)
  misc_feature (1341778)..(1391777): n is a, c, g, or t
  misc_feature (4586815)..(4636814): n is a, c, g, or t
  misc_feature (4712453)..(4762452): n is a, c, g, or t
gtctttctcccacaacccagcttcatcagacagtggtttttgtttgtttgtttgttttgtttgttcgcttgtttttgtttttttgttgttgtttttgtttttgtttttttgagatggagtcttgctctgtcgcccaggctggagtgcagtggcgcgatctcggctcactgcaagctctgcctcctgggttcacgccattctcctgcctcagcctcccgagtagctctgggactacaggcacctgccaacacgcccagctaattttttgtatttttagtagaggcggggtttcacaatgttagccaggatggtctcgatctcctgatcttgtgatccgcccgtctccgcccctcaaagtgctgggattacaggtgtgagccaccgcgtccggccaagacggtgttttgctctgggtcttaatagtgtggactttgtgttctcttttttgttgctgttgttctggtttttgtttgtttgcctgtttttattgagatgtaattcatatacctcatataccataatattcaccctttaaagtgtagaattcagtagttttttgtatatacacaaagttgtgcaatcatcatcactatctaatttcagaacattttcaacaccccaaaaagaaccctcataccaattagtagtcactccagactccccgccaccttccagctcctagaaaccataaatctgctttcactttctatggacttgcctattctggacatttcaccaaaacagaatctcacaatatgtggcctttgcatctggcttttttcccttagcataatgttttcaggttcatcaatgtagtagcataggtcaacacttcattcctttttatggctgaataatattccattgtatagatacaccacatttcatttactcattcattggtggatgcttgagttctttccacttttgactattgtgaataatgctgctatgaacattttgggctctcttttagccccaagcaaccctggtccaagttagacaggcagagggcctcttagtgccagctcacacctcccgtctcccccaggtggagctggacagccagccaaggcctgttccaagcactccaactttctctggccaatgcttctctcaatttattagatcatttgttaaagctacatgggaccattggttgatactctaatgtataagactagcaaaatgagaatttgatgcaaacccaataagaatgaaaatgtctttcagcttgaatacaagcagaacattctcaatttgtttccacatgtttggagacaactacctcttcataggaagttacataggagcctcttggctgcttcacccatccaggccctgcccctcctgctcctcccatcccagcagcttaatgaagtgggactacatttgactcaattcttgaaagtaaaaacaagcccagaacccagctttactactagtcagatatgtgaccttgggcaagttacttagcgtctctgtgtctcagccacctcactataaaatgcagataatcacagtgcctcatcatagggttgataggaaagttaaatgagataatgcatataagcactgagaacactacccagaacagaaaaagcattcaaaaaccactggctattatcatgattattatcctgaaagtttctaatactctgtctagactctactctgttgcacttccattgagaacaggggctctctgcgatatcaggagactctgcacctagcacacccaggctccaattcctggcagaagccaaccaatgggcacacactagcatcccaggcccctgtgagtgtgtcagatggaaagggacatacagagtgacttgccttttcactgccccccacaacccccgagatgcttcactgacacagtttgtatctttttccacaagaaagaacaatcaaattcctttacatcgtttcagtatgaaagtaggaagtatggttggcctagaaataggtgagatcccaagtgcataggtggctgggagagctcaggcaggagaaactgggtttcaacggagcgtggggccagtccaggctaagggagctctggttccaggtcgaaagtggggccaagactccaatggtaaggttgaatcttcaaaggaactgagtagggatttaggcaggaatgaagtcattggaaccgagaacaagccaagtcacaacattagccaactcaagagcagtttgggacaggtactgatttttttcctaatcagactgcgtctggtcacatttactttaccaacttggagacaccgttcacatttgtgaaatgaacagagagaatgattgtcctctccaaatcccccaggcttaattcatcatggttagaaccactttatcttctccttgtgcttgagtcattagagagagcaggacacatgcatttcctttagtgcaatcaggggctcaccaaaataattagcagccagtatttccaggatcttagtgtctgataaagactacaggttaggtggttcaaatcaaagggtgaccagggagagaagacgcacattaattacttgtagtaacacttggactcccttccccttgtacaatttatctgctaattagagcttaatgaacaatatccattttcttagcttctcattctagccaagcatgatcacccgtgcatttaacgactgtcccttttattaatcatcctcatgacttctcatgcaaaaagccctcctccacttgctctgtgagttctgcttcagccaccccactgcaggacataggccatgggtacccattaagccccaaaccagtcctctttctgcgaaccctgcaggtccactcagctcctaataatagctaacacatatgaatgtgtgcttcctagatgccagactgttctgagtgctttgctcatatattctcatttaatcctcacaataggcctatgaaataggcactattactatgcctgctttacagatgaagaaagtgaggcccagagaggttaagtcacttgccccaggtcacacaggtaataagtggtagagccagaagtctaacttgggcagtctggctccagaatctgtgctttaaccactgtgcctcatggcttatttgcaggccacacctggttcctggctctagagcactgggtctcaaatttagtgcatgacagagcagccaggagtattaagaaattgcagctttctaggccttcccctagagagtgtgacttggcaggtctgtacggggccctggaatctgcatgtttcccaagtgtctcaggtgattctaatgcaagcagcccaggaatcccttctagagaaatcctgctgttaactcagccctgcccctagcccttggcaatttaaggatgtctaggtctgtcatccagtgactcctgctgagtttgctcttgagggtttatatactagtccctgctgggactttataaacttgttctagtgtataagatcttgctttgaccctcagactaaaccctaccctctatcacagttctggtgatggggttcccagcccaatgcctgataataacctgaccagctccctgaaaacagggcaaccagaggcctgactatggccaccttcctgctgccaaactcatcctgatggcttgcctgagtagggttgcctatttatcaaaaatacaggatgctcagttaaatttgaatcccaagtacattcttagtataagtatattccatgcaatattcggacatacttatactcaaaattgtccactgtttatcagaaatttaaatttagccaggggccgtgtattttatctggcagctctatggctgcggaccacctgtagctgaccctaaatgagccaaatatgaggacttggcattggttggtaatgggattttctttctccccttcccccgagcaaggggctcagtcaaccctggggagcaggaactattgattcaggattggaggggcccagttctggctgtcaacttgccatctgcctctggcggatactgatttgatatatttcctactcgctttagccagcctcctctgtttgctcaggagattcataacccattcttagaaacatgcctgtctcctgtttgcctgagtagtacgctactgtagaatcgcccctgtacgtagcagtttgcaaattgacccctggcatttgaggaatgtacatactgttttgaattgggcttatatttgaaacgactgtgtgttttgtatccatgccatcttgtaggtatggtgagtctctctccgaacctcaattgcagctgccctggaagacttagcttttgggggtccttcccaggactcccccaaatcaattttgtatattccatgtaacatatcttctgagtctgacaattataaagctacctccaaatgcagacaacatctatctagccattttcacatgatgttataacacacgagcagtcagaaaaaaaaagtatacttttattgaaatagctttgtcacctaagccagagggttgggactcccttattacatctgtatccattctagtcagagggaggcccatgagtgaaaggtggggaattgtgtgtacaggaaccacctcctcaagctaagtattactggaatggagaggaaagtgtgtggagggcccaggggggagatgtgtctgtctggaatattaaagaagcaaaaggacaaactgcaataaaacacgctagcaggaccattcatttggctgtagagtcaccaaaggaaatcactggaactttctgtaagtggatgcaaatgaggaaacaatcccacactagcctgggtcgaaaagactccaagacttcacctatttttttcattgctgaggccagcgccaatttgtaagacttaaagccccagggaattagattgaacagatattgtaattccagtgacacagggcccacaatgagcccccatttggaacaaacaccaaaaacacttcctgagtctcccctctggcctgacctgcaaggctctgatctgaggagcagctgatgaagtaggcgtcaaaaagaagcccccttcctctcctgcatcctcagataattgcctgctgacaattagctagtagttctggtgcttctatcctctctgaaacagatagttcatagttaagttccactttctagtcaaaattgccttacgtcgccagtatgcttctcactgtctgctttctgttctcactgtgtgatgaagacatacccgagactgggaggataaagaggtttaattggacttacagttccacatggctggggaggcctcagaatcatggtgggtggtgaaatccacttctcacatgatgacagcaagagaaaaatgggaagagaaaaatgaggaagatgtaaaggcggaaacccctgataaaaccatcagatctcgtgagacttattcactaccatgagaacagtatgggggaaatcgcccccatgattccaattatctcccaccaggtccctcccacaacacatgggaattatgggagtacaattcaagatgagatttgggtggggacacagagtcaaaccatatcactgtgacacattacattttctaaaatgaaaaaacaaacaaaaaaataaaaaaacacattcttatgactttccttccacttggagatgtcctttggctttcacagaaaactcaagtagtttgattggaaaggattttgaggtgatcaccaaaccctttccttcactccttccttgctgtcacattctactgcattggagaaggaaggcttctggatctccagagaggcagaattcagctgccctccatgtgtgaggggtagtaatgaccttagcttctttctttctttctttctctttctttctctctttctttttctttctttctttctttttctttctttcttctttctttttcttttttttttttagatggagtctctctctgtcgcccaggctggagggcagtggcgacatcttggttcactgcaacctccacctcccgggttcaagtgattctcctgcctcagcctccagagcagctgggattacaggcgtgtgccaccacacccagttaatttttgtttttttagtagagacggtgtttcaccatgttggttaggctggtctcgaactcctgacctcgagatctgcccacctcagcctccccaagtgctgggattacaggcttgagccaccgcgcctggccagctgctctttttcaatagcatctgtgtgttacacacagtgcctcatgtcatttattcctcacagaaacccagtaagatcattggcattgttatgagggaacagaggctctgagagaagaagccatctttcctatcaggcacgtcttctctttcctcaaacttcctccctctcgtgtccactcccagtgaggatagacccaggagctgggcttgtggtcagcatgatagggggatggtttactctgggatgtaactgactagctgaatgctttccctgggcttaagctggcagagaaagccccaggatctcaggtcttatccaggtcccggaaggtagtcttagctccacccagttttctttgcaccagctgccctggtgtgaaacgctgaggtcctggtagtgctgctgtgcctcaaaagctgagccaaaaggctggctgggcacgcatgccttcctctactgcaagcactgctccaccaactcccacgtggagacgggtgagggaacttggaacatacccttaagcatccctttgaccttgcctttgagtaggagtcagttggtcaaatatctgggaatatttgggctgtttttcttgttgccaagacaaccaagcctctcttttcaggctggctaccaacagctattcttgggctgctttgggtagtgctttttgttactgctcttaagatattctttcctaccttcaggtcatgaagatactctcctatactatcttgtaaaagctttctagttttttctttcacattaggtctctagtctatctgggcttgatttttttatgtactgtgtgaagtaggactctaatttttatacatgtatttgtgtcttcttaagcaatattttgtagtttttaggatacaagtctttcacttccttgattaattttatttctatgggttttttgtttctttgttttgttttgttttttgagacagagtctcactctgtcgcccaggctggagcgcagtggcattatctcggctcactgcaacctctgcctcctgggttcaagtgattcttccacctcggcctcccaagtagctgggactacaggcacgcaccaccacacccagctaatttttgtatttttagtagagacagggtttcaccaaattgaccaggctcgtctcgaactcctgacctcaggtgatccacccgcctcagcctcccaaattgctggtgttacaggcatgagccaccatgcctggccaattttattctttttgatgccattgtaaatgcaattgttttcttaatttcctttttggattgttcattgttagtgtataaaaactaaattgaaatttatgtgttgattttatatcctgcaaccttgctgaatttgtttactactttaactttttgttgtgtaacctttaagggttttctacacataagatcatgttgtctgtaagcatagataattttacttctttttttaatttggatgccttttatttctttttcttgccaaattgcttcagctagtactttcagtactatgttgaacagaagcagttagagttggcatccttgcctcattcttgatcttacaggaaaaactttcagtctttcacattgagtatgttattagctgtgggatttttacttatggcttttattatgttgaggtattttccttctgttttattcatagttttttttttatcatggcattgttgtgaattttgtcaaatgtttctttccgcatcaattgagatgaccatgtgggttttctgcttcattctgttaatgaatgaatattccactgattgatttttgtgtgttgacccatccttgcattctaagaataaatcccacctggtcatggtgtataatcattttaatgtgccattgaatttggtttgctagtattttgtttatattttggcgtcaatattcataagggatgttggcttatagttttattttcttgtagtgcttttccctggtttggttatcagggtaatgctggcctcatgggatgagtttggaagggttctatcctcttcaatgtttttgaagagtttgaggagcattggtgttaattcttctttaaatgtttgatggcattccccattgaaggcttttggtcctggacttttctttgttggaatatttttggctgctgagttaatcaacaggtcctctggatcttgcagtcacctaggagggggcaggttgacttttgttttacctctaccctgaggttatagctttatattggggtcccagtgtattatgagggaaaatctcctaacagacgcttccctccagcctttggcttctgaaccccttgccccatgaggctgtcaaatcctaagttcaagtttgccaggataccctcaaagcaaatgttttattccatgaaactttgtgagctatcatgtttccttagatttcagacttgtagtttcattctctgtttcagatattgtgtgcttctaagatttttaaaatatgtattctgtctaacttctctggttgttttcagcagatgaattggcccaattaacctagcctgccatattcctagaattggaagtcctcaatccatttcattttctatgaagagagttctcaccaccagaaaacggacttatattctggagtgcatggtccaactgcactatgtacagacttccaaaccattcctttccctgatttttttcagcctcccatctctctcctgtcctctggatctccaaatcctgattgtctttagggctcttccataaaactggttccctccttaacagcccgttcttcatatactccagcagacagctcctttcatttctatttgtcagttgccactctttcatctgcattatgccctgcaaacagtcactgaaatctctctatgagaatatctcatgttctctttgtgatccttgatttacactttttcccttttattattcttagtggcatctcaatagggcttaaagataaacctaagcactcagtctatcatctttacatggtagccctcttcactcttcaggccactataacctggatttcatctccaccactcttttgaaactgactttggcaaggtcactcaaaaaccacctctatgttgctaaattcaatgaatattttccattagtcatcttctttgacatctccacagtatatgataagattaaccattcccttcttgaaacactctcttctctttgtttgcttacatgacaacatactctcttgaatctctgcttacccctctggccatttattttccagctgcttcttttcctctcaccaacatgtcaatgggcaactgaactcaagtttaaaggatgtgatctctatttttcacgctattcaatttgaacaaatggccttgactctgcagacttcagtatatgacttctagaagcatttccagctctaagtttttagaatttcatatttttgaagatcttttcaggaatggaaatgatagtaaataatttctatgaaagcttagtaggaccacaccagttccaaacaacaatacttaatgctctattctggagaaagagactcccttagagaagcaaatgccctttggggctcagcagcttttatttagctgtgtgtgatgtgtgaccaaatgctttgtcctagacctccatcttgtgtgggactgtgggtttaagcagaagtatttagtaaccttacctggggctatgtcaaaaagaggattagcaaaagaatcacagcactggttccttctttagatcacagtgtgatatcctatttgacacagagatatattaagaaggccatctggaaaaattaattcccagcaaatgaatcgtgtatcttcagtactctgtagcaattatgggatatatccttttataatttagtatcttgtataggatccaaaatcaaaccactgtgaaatgttgatggtgaggggaaagaaactagttttttccaccagtcttttatttttgtgtctaaagttccaagatacactgcccatttttcactagcttaatttttcttatgtgatatgtgattgtttaggaaaaataaacagcagtttatgctcaaattgaagaaaagacatgttattcatttctggtaatggtttttcagaaagaattgagagataacatatatctgtagcactctcaggatgacttaggcctgatttctaacccagcactgtccagcagaactttctgtgatgatggaagtgctctctatctccaatatggtagccactagctgcctgtggctattgaacacttgaaatgtgggtagtacaactgaggaagtgatgtttaaattgtatttaattattaattaatttagacttagagttaaatagccacatgtggctcctggctacagtagtagcctgcagttatagaaaatcgactttagtgttttccatctacgcaatcttggagtcagagtgcatatgaaagtgaagcaaatggtttccaagagccctcttgattctaaagacttcccttcattctgcccccactgccacctcctcagagaagagtcataaaaaatattctccaaatagcatgaagccaaacaggaagtcagaatggcaggacaggttggctggtgaaatgagagctgactcctgagtccatatccaccctaacatttgtggggcccaggacaaaagaaaaaatggagggccatgtgctgtatgtctaaatatttaagttttaatgaaggtaacaagacgttaaataaaaatgtgctctattctcctagctttgcaattataacttcctaatgaccaaaagggtaggtccaaatttaaaattcttagactcttcagagttctactcttgaacttggatagtcatcccccagctcctggttgaggctactccctttctcttcccactaccactctatccaacactgtgaggggctccctttacatgcttgtggacacctgagcatgcacatccacacgttggccaaactccccacaaacagccaccacttggccacatcttgcacgttgtcaatgtctcagttcaccttcaggaagatgtacctaaaagcaggcgaggggcagtatggacagggaattcttcagtcctgggcaactaaagcatggtctagaagtgcggggagaggtatcagctctggtctagtgcaacctcttgatcctttggactcgttgaccctgccatgagtcattcactttaacagatattgctctggccctcctccagccttgccaccccttaaagggcaggttccagggcaagggccactcctgccaagtgctaagtgcagttttacctgagtttaagactgtgaagagttatgataaaccttaccttaaatcagaggtgtggcctccacactgtgctgtggaagagctagacttgtggacagtatacctgagctactttcaagatggagtaactgatgtgcccagagaaagtccaggccttgaaggtgacggagagtgagagatggaggagcctgcctgtaagaaaggggggaaagaaaggaaggcatttcagacaccaccaccatgccctttgccagtcttagcaccctgcctggcctgagggggaagagatgtaaaaagtcagctgtaggcaaggtgcaggtaatgaacacaaggattatggagaagttgcgaggccagccgaggctttgcagtgtgaatacataacaagtgcaatcaggtgataagacacaaggcagtactcaggcagtgctaggtgacagagggatggagggaagctgccaggaagtaggcaccaagggaaatttctcagcgccagggactggaaagagaagaacactgcaagggcagtagccagggccctgcatgtggcttccctgtgccaattgaaaattctgtgttggggtccgtggcaagggaggagcagttgggtggggactacaagccaggctgggaaaacccagagggcttgagagctgagaagtcccatggagattgggagggaagaggctgtgcttctggcccacagttcttgagagcagagcagagtccctaggtgcagggccccaggggacagctgcatttatgggaggtcacggcagagaagcaaagggactcatgcatctggcaagatgaggggctgggaagtgaggtgaggctgggccagcataagaagccaggaggggaaatggggagaagaggagactgagtcaggggaaaagggatgaatgtagctgtcccagtggagggaggcaggccaagcctgtgcagaccagccttctagggagctcctgggaagagcctattctagagcccttttcagaggatggattccgaaggctggatgcctcgattttacttcctggagctaccatataagagtcatgttagtttggacatgtcccttcacctctctttgctactgttttcctcacctaaaaaaaagggataatgacacaactaatgcaacaatatgggattgtcattatgaatacagaaaataataattggaaatctctccaaaccaagcctgacaaaaattagcactcagtagatgccagctgttctaatcaggtatcagagctgggccacatgtcccccctacagccaggttaacttcctttgcacctctctaggataactcacaagctgccatatcaggactttggcctggcctccaacctagaaatgctcctgggcattgactgtggtagtggttttaggcacttttcattgaccaaggtggaaccctgtagtcctgtgcaacagagaggttgactgtgttagcaaaacaaaagggagcatactctcactgacagcaagaaaccaaaggaaggcttagccgggtagggatggcatgggcatgccaccaaaatacatactcttgtccagtgtttgtgcctagtgcacttgacctgcacaggaaaatgggatgacatgaccccatatctagaaaatcccatcctctcagcccaaaatctccttaagctgataagcaactttagcaaagtctcaggatacaatatcaatgtgcaaaaatcaaaagcattcctacacaccaacaatagacaagcagagagacaaatcatgaatgaactcccattcacaattgccacaaaaagaataaaatacctaggaatacagctaacaagggaagtgaaggacctctacaaggagaattataaatcactgtgcaaaagaaatcagagatggcataaacaaatggaaaaatgcccatactgcccaaagtaatttatacattcaatgctattcccattaaactaccatagacattcttcacagaattataagaaactattttaaaattcatatggaaccaaaaaagggcctgaatagccaaggcaattctaagcaaaaagaacaaagctggaggcatcatgctatctgatttcaaaccatactcagggctacagtaaccaaaacagcatggtactggtacaagaacaggcatatagaccaatggaacagaatggagaacccagaaataagaccgcacatctacaaccatctgatctttgacaaacttgacaaaaacaagcaatggggaaaagattggattccatatatttaataaatggtgctgggataactggctagccatatgcagaaaattgaaactggactccttccttacaccatatgcaaaaatcaactcaagatgacttaaatgtaaaacccaaaactatgaaaaccctagaagaaacctaggcgatgctattcatgacatggccaaagatttcatgatgcaaataccaaaagcaagtgcaacaaagcaaaaattaacaaacgagatctaattaaactaaagagcttctgtatagcaaaagaaactatcaacagaataaacaaacaacctacaagatggaagaaaatttgtgtaaactatgcatctgacaaaggtctaatatccagcatctataaggaacttaaacaaatttacaagaaaaaaacacaaaaccccattaaaaagtgggcaaaggccatgaacagacacttctcaaaagaaaacatacatgcagccaacaagcatatgcaaaaaagctcaacatcactgatcattagggaaatgcaaatccaaagcacaatgagataccatctcacactagtaagaatggcgattactaaaaagtcaaaaaatcacggatgctggcacggttgtggggaaaaaggaacacttttacactgttggtgggagtgtaaattagttcaaccattgtggaagacagtgcagcaattcctcaaagacctacagacaaaaatatcattcaacccagcaatcccattactgggtatatatgcagaggaatataaatcattttattataaagacatatgcatgcctatgttcattgcagcactattcccaatagcaaagacatggaatcaacctaaatgcccatcaatgatagactagataaagaaaatgtggtacatatataccatggaatactatgcagtcataaaaaaggaggagattatatcctttgcagggacacggatggagctggagtcattatccttagcaaacttacacaggaacagaaaatgaaatacctcattttctcacttgtaagtgcaagctaaatgatgaaaacacatggacacatagagggaacaatgcacactggggcctactggagggtggagggagggaggagggagaaactcaggaaaaataataatgggtactaggcttaatacctgggtgaggaaataatctgtacaacaagcccccatggcacacgtctacctatgtaacaaacctgcacatcctgcacatatcccccgaacttaaaataaaagttaaaaaaaaaatttaaaagatgaaatgcggtcttaagggtggagccctaatccaatagtattggtattctgataagaaaaggaagagatgagagagagagagagagagagagagagagagagagagagagagagagacagaaagagagaaggaatctgcatgtgcagaggaaagatcatgtgaggaaacagcaaaaaatcagctgtctacaagtcagaaagagagtcctcaccagacaccgaccctgctggcaccctaatcttagactatctgacctccaacctccaaaactgtaagaaaataaatttctgttgtctaagccactcactctatggtattttgttatggcagcacaatctgaccaacataaagagcgtcctcctaaaacttcatgtctacctggaaataaggtcttggcagatgttattatttatgtgaaggtgaagtcataccagattagactgggccctaaattcaatgcctagtgtccttatgaaaaaataccacgtgaagacgcagtgacacagagacacagaggggagaactccacatgaagatggaagcacagagattgcagtgatgcagctgcaaggcaaggaataacaaggactgatagccaccaccagtagctagggagaggcaaggattcttccctacagtcttcagaaaaagcgtgaccctgctgacaccttaaattcagacttctggccacagttaactaatacagtggtagagctccaagctctttctgttctttctcctgccccacactgcttctccaattaaatttacctctatttctgaattcagaagctgtgttaagacttttttcttccaacaagatttttttttaagagacaaggtcttgctatgttgcccaggccgaattcctgtgctcaagtaatcctcctgcctcagcctcccaaagtgctgggattacaggcatgagtcaccatacgtggccaagaatttttaatgttcaacataattttttatttttatttatctatttattttgagatggagtcttgctcttgttgcccaggctagagtgcattggcttgatctcggatcattgcaacctctgcctcccaggttcaagtgattctcctgcctcagcctcctgagtagctgagattacaggcccgcaccaccacgttcgtgtaatttttgtatttttagtagagacagggtttcaccatgttggccagtctggtcttgaactccttacctgaggtgatctgcccacctcggcctcccaaagtgctaggattacgagcatgagccaccgcagccaacaacgtaattttaaaaaatctcttgggaacaatttcaacagtcaagagagtgtaaggtgaaacataaaaaccttctacctccctatcctcttgtcgtactgcccctccccagaagggacagtgtttagcatcccatttggggtccctccagaggctgcccatgcgtggggatgatacagaccctttttcttaaccagctgataccttattttgcacactgataagtaacttgcttctttcgcctaccaaaaagcctctgccgtcttcctttggccatctgggagaaggctgtcccgggtagtgctcctcagcagcaccttaggggacagtctctgaagtcgtactgtatgggttcaaatcctggttctaccacttaccagctgcatgattctaggcaattgcttaacctctctcctcccagctggctcatctgggaagtgagtaccaatctcacaactttctacaaggattaaataaattaatgtacacaaaacacttggaacagtgcctggtacagagaaaatgctagataccttggtttcgttaacaggcttgtggtattcccaactatgaatggatcatcatttatatctacacggacatagacactgcttccagcttttcactggtagttatcacttcagttaacatctttgtgtgtgcccccttgtgtgtgagtgtctagaggataaattcatggggattgagttggttgtgccagttttccctttttctgttgcctcacacccacacgaacaccaggttcctataaaatactttcaaattgtaatcagtaatgctgtcaacattgttgcatatattgtggtctagtaagcagtgtctgttcttcctttcttttgataaatacttgcattatttgttcataaatatatttcatggttgtttacgaatggcaaagtgacaactatcttagagtttcctctttcaggatggcttttcacagctatatagtggttgttcaaaggccattgtaagagcatctgggctgggcactgtactcctagcactttgggaggatgaggcggtggatcacttgaggtcaggagttcgagaccaacctggccaacatggtgaaatcctgtctctactaaaaatacaaaaattagccaggcgtggtgagggggtggggggcacccataatctcggctacttgggaggcaggagaatcgcttgagcctgaggggcagaggttgcagtgaaccgaaatcacgccactgcactccagcctgggtgacagagcaagactccatctcaaaaacaataagtaaataaataagagcatttggccacatctggtactggagacatgtaagctcagagggccctgctagtagactttcctggctcagtatatgttggggtggaaattacctgcactccctttagacaagaaaagctgattcagaacctgtcatacttggtattaagctaatggagcccactctattttcagacaaaccccagtgtctgaacccttggataatttgcagtggagtcatatggactcagggtggcttgccaggggtcagtcagtacgtcagaaaaaaatgagattggtgacgtggagagtattattagcattcaagtgctcagttccagcagcaggagcgtacagcatgaacaaccaacttggccattagtcatcttgaaatcacctgaacggatgactcttgataagataggaaaaaaacaaccattgtacaacagagaaaatatgatttttaggaaggtagagaggaactagtgtttgggttcacttgtttgggggttgtttctcgctgttccccttcctctgtgctagaaagaatggaaagaagaaagtgataagtgaataaatatagaaaaatacaaaatattcatagaattatgaaatcctcttctcaaaaataaaagatttcagaagtcatccaggttagtcccttcttgtacaagtgagacaactaggtctctgagaaggaaaatgatctgatcccagtcacctgtgcagggaatccaagcaagtcaattacgttcattcagccccaagtctcttgcgtgctccgggccctattctgggggttagaaacacagggaaaaacaaagcaaggccccagacaggcttctctttaggttgggcagaggtctgaggtatagagagaataatgatgcaaggcaaggactgggagaagagcagggaacagaacaagaagcttatgggtggttaagtaaagaccaaaaatgaaggctttaactgctgcagagtctgaagctcccacaacaagatacgcaggtaggcttggttccatttaacagaccaggaaagtgggaaccctctggaagctggaatattcccacccaattgttgcagaatgaaattgtcatttaccaaaagtccagtagtttgcctccctgcctcaggcattgtgggggttcaaagagtgatgaagacactgcacttctgaaaatcacagggcagcaaaagcctcaagaagctaaatgattacatagagtccgtggagctgtgataagcgcacgaacactccaacttctgagtcctttaagatttacacacacaaacacacacatcccacacacacaccaatcaagcagggtgtgcttaattatataaacacaaaagagttggatgaaataagaaaacaggtgagttttggattttttatacacttatccgatgaagccttacagcaaagttgcagcgatgagacgttttaagagaaaagatttccatcctttgtggagagaatattacatctgaagcagtccccagggccgtgtgaattagagacgctcctgaataagaatgagagctccatgttcatgctgtcttccccccagcctgcccccagcactctaattatagagtagtgggaagattgtctctcttgttctctgaaaatgacttgcaaacaagccaaatcatcttaacaggtgaagcccctagaactggttgctgccctgtgtgtgtggtgatcagacttgctggaagatttttctgacttggaaatgaactgatttgaaagtcgtataaaatgcaactgtgcttgcttatacattgactgaatcatctgtgctgacgagaacataatgacacagtcacgactctctgagatgtgtgcctctggcactctccgcaaaagatggaacggaccactgggaaaagacttcctttgaagcatttgaaatcctctatcctcccaccccccacccattgtagtcccgccctgttctccagtagaaatgttgttgctcctccaaatgcagtcattctgtgtgccaattattcctaacatggtttctatgttcacattttctcaggattaaaaacgtgtccgagaaaagcagaggtttttaatccatggccacgatctgttcagcagcagcagaccccctgaatgccacatttcgtgcatctgcagttttctgattctcaacagagttcacaattcccaaatgcttaaaagttcatctttaagtgatctgagaaggtacctgagggaccagtggcctgttattttgggcagaagcccaggaggggttagcagccaagtttagtcacacctgaaaacgtttgaacagcccccaatctacatcagggcacccccaatgatgcaaatggaaaataactgagcaaatgagtccactagttaaacaacagcacccccagcgtgtagaacggcgcaagcaatgcaaagaggaattccgccgcaggcagttaggatggatggctggggatgctggagccccggaaaagtactggtttccagccagcactagcagtgattcaccatgaggtgaccaatgatgcctaacttctaccaacctcccagcgtatattcaagggctttctgctgcatattggagtcgggagaactctagaccagaaatcagaactctggaattcaagtactggctctgcctttaactagccctgtgattccgggcaaatcacttcactccttagggcctttattctaatgtaaagcattgcttccaagccttaatggatatcccttagttttcttattctgacatctatccactcctttatttttttttcatgtttccataaatgtttcttgagtcactaatatatgccagtaattaggtgcccaagaccctggttaccgtctccatgctcatgctgaatttatggattcaaatttttctccttatcctctttccagacaggagaggtctaattaggctaactccttgcatacgaaaaattccaaggccaggtgaggtggctcatgcctgtaatcctaacacttggggaggccaatgtgggaggatcacttgagtgcaggagtttgagaccagcctgggtaacatagtaagacactgtctctacaaaagattaaaaaaaaaaaaatagctgggcatggtggcgcacgcctgtagtcccagctacttgggaagctgaagtaggaggatcacttgagcctgggaagttgagaacacagtgacagcaccactgcactccagcctaggtgacagagtgagaccctgtctcaaaaaaaaaaaaaaaaaaaaaaaattccagcccccatcactacccctgctctccctgtgctcttgctagacattgtcatacctacctgcctcaatatacaaatgaagaggccaagatccggatacaggtagagacttgtcccaggatgatccagtgggtcacttctcacagttcctgggtgcacccccagagaagctttgaagcacatggaattgttggggaatccatttctctgattttaaatctgtataatggaccttagagaaactttcagcctgaagaggaatacccagtgacccagacctccttcctcagcgaccactggcgaagaggaaataaaataggttagccctggtgctaggaggtatcccgggaagccaggctgaatcattctgagagtggggataggagcggaaagaaatttggcctttgaaatggataggtctggtactgcagagatgggggaacaggccacctggggccctgtggcagggcaagcccgggctgcaactaaagaactaagatccagcaagattccatcttagagctggtgcaaactgaggcaatcggtaagggagagtatgtcattctcagtgaaagagcgccctctagtgtccgtaagagaccttggcaccactgaagaatttggaaagaataagaagtacacaatctcagtaaccagatgagactcaacttgctacctttccttgattgtagccaaatttttcctccaacacatagatactttcaagtaatgaaaagcaattagtcatgaggtgaatttgtggatttccaggaattataagcataggtctgagtctgaagcctgaaggagcacagacagcacccatgggccaaacctatgctctggaatattcttcatggtgtaggtgtcttgcacacgtgtgcatgtcatttttctttacaatgtaatttttaatatttttttagaaaattgatttatacttatttcaaaaagcttggaaaacataaaagtaaatctctggccttgaagaagtaacagaatctggaattactcttccaccataagcaactggaagttggatacaacatacgaaagaactaattttaggcactagacaagaggcaacacgcatggcatcacagataaagaaagaaatgaggtaagcccaaaccttggagcatggaggagtgactcaagcagagcaaagaagtttccctgagttgaagaattggagattaaagttcaaggaggctgaagtagctaaaatgtgcgggacagagtaccagagatgaggcaactgcatggagaaagaactccagaaatctgacatgggctctccttaggtctttactgagtactagagtgagcaaagaacaactgggaagttttaaaagaactatgctcagaactcacacaagactagcagacattcaaactctggcccagaggagtaaagaatcctcagtagttatctatgtcattcaatggagaccccagagggatcatacattagtaataaatctgaggtatccccagagaaaaggctactctggacctcctccagcaaagcttaaaaacaaaacttaaagagacaaaacagagtgacagacaacttgcttctctgtcaaaacaaagtcccacagtctttgaagaagataaaatccactcaatgatgtaacattgacagtgtccagaatccaatcaaaaaattgtcagatacactaagaagcaataaaatgtgagccaaatggaacttccagtgcagaaaaatatagtacctgaaatgaaaattgcactggataggagtaacactaattagactttacagaagaaaaggttagtaaacttcaaaacataacaattaaatctatatgaaatgaagattgaaaataataaacagaatctcagtgatctaggggactcagaagggggtgcagaaaaaatattcaaagaaataatggccaaaatttttcaaaatttactgtaagctataaacccacagatcaaaagctcaacaaactccaagaagactaaacatgtagaaaaccacaaggcacataaaaattaaattgttgaaaaggaataaagctggagacatcacactatgacttcaaaatacactacaaagctatagtaacaaaaactgcatagtactggcataaaaacagacacatagaccaatagaacagaacccagaaataaattcatgtacttacatccaactgattttcaacaaagatgccaagaacattcaataggaaaatgatgtctcttcaatgaatggtgctgagaaaactggctatctgtatgcagaaaaatgaaactagacccctatatctcaccacataaaaaaatcaaaatagattaaatacttaaatgtaaagcctgaaactatgaaactaccagaagaaaacattggagaaatacttcaggacattggtctgggcaaagattttggggtaagacctcaaaaacacaggtaacaaaaacaaaaataaacaaatggggcttaaactaaaaaagttctgaacagcaaatgaaagtagagacaacctgttgaatgggataaaatattttcaaaatatgcacctgatatgggaataataatgtccagaaagtacaaggaactcaaatcaacaggaaacaaacaaacaaacaaacaagtaatccattaaaaagtggtcaaaggacatgaatagatatttctcagaagaagatatacaaatggacaacagatatatgaaaaatgctcaacatcactaatcatcagaagaaatgcgaatcaaaaccgtcatgagatgtcatcttaccccattcttaatagctactattaaaaagacaaaaaataacagacatcggagagaatgtggaaaaaggggaacttgtatacattgttgctgggaatgtaaactaaaacagccactatggaaaacattatgaaggcttctcgaaaaatgaaaaatagaattactattttgatccagcaatcccactactgggtatttacccaaaggaaaagaaattaatatatcaaagggattgcagcactattcacaagagcaaagacatggaatcaacctaaatgtccactaatgaataaatggataaagaaaatgtggtacatatacacaatagaatactatttggctataaaaagaatgaaatcttctcatttgtagcatcatggatggaactggaggtcattatcttaagtgaaataacccagggacaataagacaaatatcacatctgggagctaactttgatcatatggaggtggagagtggaaagagggataacagagactggtaagggtgagtcgggggagaagggaggctgaagaaaagtaggtggctgtgtccccacccaaaatctcatcttgaattttaatccacacatgtcaaggagggaccaggtggaggtaatcagatcatggaggaggtttcccccatgctgttctcgtgatagtgagtgagtctcacgagatctgatggttttataagagtctggccttacccctgcttgcactcactccatcctgctgccctgtgaagaaggcgcctgcttttcctttgccttctgtcatgattgtaactttccggaggcctccccggccatgctgaactgtgagtcaattaaacctgtttcctttataaattacccagtgttgggtatttcttcacagcggcatgaggacagactaatacagtgacaatacttcatgaaaatgtcgcaccctaaattacatcctaagtaccctgacttgatcactacacattatatacatgtaacaaagtttcacatttactgcataaacttataaaaaaaaaagaaatcaatttgatgaaaaccaatggtaaagagaaaaatatatctatttaaatccagaggagagaaacactttatttgtacagcaaagttaactcaatttggatcttcaacataaatgtgaaagctaaaactataaaacttctagaataaaatatagaagatcattgtgatgattgggttggcatagattatttttatatacaagacaaaaaacacaaatcatccaaataaaagtgcactgtactttgttaatattttaaaacttctgctttttgaaagattccattgagcagggggaagcaagccacagaatggggctaaacatttgtaatacacatatctaacaaagaactagaatatataaagaatccttgtaactcaataaaaataagataaacaacagcgttttttaaatgaggaaaatatttgaacagtcactcaccaaaatatacatgcaaatgtccaattcacgcatgaaaagctggccaacatagtcataaaataaattaaaattaaagcctcaagatgccattacccacccactaaaaaagctaatttttttaggttgataatatcaagtattggcaagaatttagagcaacttgcaactttcatgcattgctgttgggaaaacaaaaccatgcaaacacatcaaaagctaaacatacacctgccatgctactgagcatttccacttttagctacttacttcagacatggaaacatatgtccacacaaagacccctgcatcaatgttcatagcagtttagccataagagccaaaaactagaaacaacccaatgtcaccaacggaagaatagagaaaaatgaatggaatcctagtcagccatatgtaggaataaactatagatacgtataacaacacgaatgaatccccgaaatcttatgctgagtgggggaagaaaagccttacacaaaaattacctattgtctgactacaattatttgaaattttagaaaaggatgaaactaatatatgtcgggaaaaaatcagagtggtggttttttctgggtgataaacgtgggaatttactgggaagggacgtgaggaaacttcgggtatgatgaaaatattgtatgatttgatggtaattccacaggtgtatacatttgtcaaaactcatagaaatgtgcacctacagtaggtgcactttactttatatgagttatactacaaacatgtttttaacaatctcaaatctattaaagacctacatttgtaaagaataactttaaaaccaagagaagaaaatctagaatatcttcaggattgtagggtagagcagaattcctggtgaagatgcaaaaaacccaagtcatgatatttatgatgtatatgatatttaaactttttatgtccagaatgtgtatcttgtacaaatcaaacataaaaagacaaattactcagcagaaaatgggtaatgaatatgaaaacaaagttcacaaaagaagaaattctgatgataaacatgaattttaggtgtcccaatctgtggggtggtgtgtttttgtccaggagaactacatggccaggtgaatggttaaacaaattgttgtatgtccataccaccgctgaaaagcacatggaatactactttaaacaagggaatgagctactgatacaacaatttggatggatttcaaggacatatgctgagtggaaaacaatttgtaacaatttgtatctctaaagtcaatgtatgtataatccagactgagtaattcaacttctaaatatatacccaatagaaatgtgtttatcatatacacaagagtgttcatagtattatctgtaatagtcaataattggaaacaacccaaatgcccatcaaccatagaatgtatatataaattgtggtaatatcacaacagaatactacgcagtaatgaaaagaaacaaactacaaatacatataataccatagatcaacctcacaaatgcaatgttgaagaaaggatgtaagacccaaagaaatatatactgtaggatatcatttataaaagcttcaaagacaggaaaattaatctgtaatgttagaattctagacagtgtttacaactggaaaggaaagagaagtaatattggggaggtgaattccggagtgttgtccatgttctagctcatgacctggatggtggttatacaagtgtgttcatttcattataatttctatagttttctatatctgttttagttttatacaaaagtttaaaatgtgaatcattagtaaatgatttggagtcatttgatctgtttgcttctgaccaattgtatgggttaatagcagacccagagactatctagacaaggttttgaggatgggaactctagtctcctagttatgaggcttacagcctacctattctctttttattattttaaattcagagggtacatgtgcagatttgttacgtgagtatattgcttgaggctgagctttgggcttccattgaacccgtcacccaaatagtgaacatagcacccaataggtacttttacaacccttgccccgctctctccctctccccttttggagtccccagtgtctattgccccctctttatgtccatgtgtactcaatttttagctctcacttataagtgagaacacatgctatatggttttctgtttctgtattaattcccgtaggaaaatgccatccagctgcatccatgttcttgcaaaggatatgattttgttcctttttatggctgtatagtgttatatgctgtatatgtaccacattttctttatccaatccatcgtggataagcacctaggttgatttcatgtatttgctattgtgaatagtgctgtgatacacatgtgagtacaggtgtccttttggtagaacaatttattttcctttgggtatatacccagtagtgggattgctgagtcaaatggtaattctatttttaattctttgagaagtcttcaaactgctttccagagtggctgaactaatttgcatttccaccaacagtgtataaatgttcccttttctctgcaaccctgccaatatctgtttttttttttattttttaatagtagctattccgactggtatgagatggcatctcactgtggttttgatttccatgtctctgattagtgaggttgagcatttttttcaagtttgttgcatgcttgtatgtcttcttttgagaggtgtttattcatttcctttgcccactttttaatgaggttgtatatttttattaatttgtttaagttccttattgactctggatattagtcttttgtcagatgcgtagtttgtacatattttctcccattccataggtggtctgtttactcccttgatagtttcttttgctgtgcagaagctctttagtttaattcattcctaattgtctatttttgtttttgttgcatttgcttttgaggacttagtcataaattatttgcctcgaccaatgaccaataccaaagggtatttcctaggtgttctggaatttttatagtttgaggttgtacatttaagtctttagttcatcttgagttaatttttgtatatagggatagattgtggtccagtatcattcttctgcatatggttagccagttttcccaccaccatttattgaatagagagtcctttccacattacttatttttgtcattgaagatcagatggctgtatgtgtgtgttttatttctgggttctctattttgttccattagtctatgtgtctgtttttgtaccagtaccatgctgttttggttgctgtagtcttgtagtatagtttgatgtcaggtaacgtgatgcctctggctttgttctttttgcttaggattgttttagctatttgggctcttctttggttccacgaattttagaaaagttttttctacttctgtgaaaaatgatgttgattgtttgataggaataatgttgaatctgtaaatactttgagcagtgtggccattttaatgatattgattcttcgaatctatgagcatggaatgtttttccatttgtttgtgtcatctctgatttctttcagcagtgttttgtagtcttccttgtagagatctttcacctccttagttagatgtattcccaggtattttatttttttgtgtggatattgtaaatggggctgcattcttgatttggctctcagcttggatgttgttggtgtataggaatgcttctgatttttgcacattgattttgtatcctgaaactttactgaagtcgtttatcaggtctaagagtcttttggtggagttttctgggtatagaatcatattgtcaacagagataatttgacgtcctcatttcctatttggatgtcttttatttctttctcttgcctggttgttctagctaggacttccagtactatgttaaatagtagtggtgacagcagtcatacttatctttttctggttcttagggagaattcttccagcttttgcccattcagtatgatgttggctgtgagtttgtcataggcggcacttattatattgaggtatgttccttcaatgcctagttggatgagggttttttttttattgtgatacctatcgtctttatcctttatttatcagtcttcaccttttattttggcatttcatgggaagtcattacccataacactgtccattcacctggaagcatttggaagaagacggtgagaaaaggcttttctttttcctcagtcttacctcctgctaagttttctgcctttctctccatttttaggtggaatatcttcagtattagctgtctattgtaagacatcacagaactgcaggaaatagccaatacacactgatatccagaattttccttcttattttccctaattatacacccttgtgtaaatgtcttgcaataatcaccatcttccatgcctacaattatgtggtcctcaatgcccttcctcttacctcctccactcagctgactttacatttttagatctattacttggagcaaactacttgtggtgcaatattctgcattaatcaggattctaatgtgaaagcaataaaaagtatctcttgccaataacaggctctgaaattgaggcaataattaatagcctaccaaacaaaaaaagtccaggaccagacagattcacagccaaattctaccagaggtacaaagaggagctggtaccatttcttctgaaactattccaatcaatagaaaaagagggaattccccctaactcattttatgaggccagcatcatcctgataccaaagcctgggagagacacaacaaaaaaagagaattttagaccaatatccctgatgaacatcaatgcgaaaatcctcattaaaatactggcaaactgaatccagcagcacatcagaaagcttatccacccagatcaagtgggcttcatccctgggatgcaaggctggttcaacatacacaaatcaataaacgtaatccatcccataaacagaaccaacgacaaaaaccacatgattatctcaataaatgcagaaaagccctctgacaaaattcaacagcccttcatgctaaaaactctcaatacactcggtattgatggaacatatctcaaaataataagagctatttatgacaaacccatatccaatatcatactgaatgggcaaaaactggaagcattccctttgaaaactggcataagacaaggatgccctttctcaccactcctatttgacgtagtgttggaagttctggccagggcaatcaggcaagagaaggaaataaagggtattcaattaggaaaagaggaagtcaaatcgtccctgtttgcaggtgacatgactatattcagaaaaccccatcgtctcagcccaaaatctccttaagctgataagcaacctcagcattctcaggatacaaaatcaatgtgcaaaaatcacaagcattcccaatacaccattaacagacagagagccaaaccatgagtgaactcccattcacaattgctacaaagagaataaaatacctaggaatacaacttacaagaaatgtgaaggacctcaaggagaactacaaaccactgctcaacgaaataaaagaggacacaagcaaatggaagaatattccatgctcatggataggaagaatcaatatcgtgaaaatggccatactgcccaaagtaatttatagattcaagaccatccccatcaagctaccaatgactttcttcacagaattgaaaacaactatgttaaagttcatatggaaccaaaaaagagcacgcatagccaagacaatcctaagccaaaagaacaaagctggaggcatcacactacctgacttcaaactatactacaaggctacagtaaccaaaacagcatggtactggtaccaaaacagagatatagaccaatggaacagaacagaggcctcagaaataacatcacacatctacaaccatctgatctttaacaaagctgacaaaatcaagaaatggggaaaggattgcctatttaataaatggtgctgggaaaactggctagccatatgtagaaagctgaaactgaatcccctccttacaccttatacaaaaattaattcaagatggattaaagacttaaatgttagacctaaaaccataaaaaccatagaagaaaaccagctgggcgtggtggctcatgcctgtaatccaagcactttgggaggccgaagcaggcagatcatgaggtcatgagatcaagaccatcctggctaacacggtgaaaccccatctctactaaaaatacaaaaaattagctgggcatggtggtgggtgcctgtagtcccagctactcaggaggctgaggcaggagaatggcgtgaacccaggaggcagagcttgcagtgagctgagattgcgccactgcactccagtctgggcaacagagcaagactccgtctcaaaaaaaaaaaaaaaaaaaaaccctagaagaaaacctaggcaataccattcaggacataggcatgggcaagatcttcatgactaaaacaccaaaagcaatggcaacaaaagccaaaatagacaaatgggatgtaattaaactaaagagcttctgcatggcaaaagaaactaccatcagagtgaacaggcaacctacagaatcggagaaaatttttgcaatatacccatctgacaaagggctaatatccagaatctacaaagaactcatacaaatttacaagaaaaaaaacaaacaaccccgtcaaaaagtgggcaaaggatatgaacagacacttctcaaaagaagacatctatgaggccaacagacatatgaaaaaatactcatcatcactggtcatcagagaaatacaaatcaaaaccacaatgagataccatctcatgccagttagaatggcgatcattaaaaagtcaggaaacaacagatgctggagaggatgtggagaaataggaacgcttttacacttgatgggagtgtaaattagttcaaccattgtggaagacagtgtggtgatccctcaagtatttagaactagacctaccatttgacccagcaatcccattactggatatatacccaaagaattataaattatgctactataaagacacatgcacacgtatatttattgcagcactattcacaatagcaaatacttggaaccaacccaaatgtccatcaatgatagactagattaagaaaatgtggcacatatacaccaccgaatactatgcagccataaaaaaggatgagttcatgtcctttgcaaggaaatggatgaagctggaaaccatcattcttagcaaactattacaaggacagaaaaccgaacactgcatgttctcacacataggtgggaattgaacaatgagatcacttggacacaaggcagggaacatcacacactggggcctgttggggggtgggggctgggggagggataacattaggaggaataccttatgtaaatgatgagttgatggatgcagcaagccaacatggcacatgtatacctatgtatcaaatctgcacgttgtgcacatgtaccctagaacttaaagtataataattaaaaaaaagaaagaaagtggctcttgtttaataaagcagaaaagtaatttaaaacaagaatatttggtaaagcattaagtcactgggtgcatccaaaaactagatttaagttatgtggccagaaacaattaatcaagtcacaccacaaaggtgacctgatgataacccttctgctgtcaccaccatgtactagatgctgtagctgtaatctcaaaccgtaggcaatagacactggacactgccactaacattcctgatagtgctgtccctaaaaacatggtcttgctgcaaccacgaccaccagagagagaataattctctgctgcccttattctttagatctctaaatgtcaaattcaaagacccagaaaggtgcatcattggctgagcctaggttatgtcccacatcatagctgcaaagaatacttggatatgtgacatttttatcttctatactgggaaatgggctctgcctcctatactaggagtcatgagacaaggaattcttcaaacatggcaagagattcagatactggacaattctccagatgaaaaatatctatttcgctattgttaacttcagccagcacctggcacatagtaggaagttaatgaatatttgttggtggagtgattgaaaagcataaaagactgaaagtgactaacaatagtctacaggaggtgatcaggtaggtgagaagggacttaaatagcatcctccccagtacaggatacaaaatggcagttgggtcaaagacctgggcaaggcaatgtgtgcctggtccaaccatgacctcccaggcagggacagctacctgtgaggatgccatggatagacagaaggccacctaggatttccacctccaggctttcaagtacaagcatactttgttttatttgtacttcacatataacgtgttttttcacaaatggaaggtttgtgcaaccctgtgtggagaaagtctattggcgccatttttccaacagaatgtgctcacttcatgtctctgtgtcacatttcggaaattctcacaacatttcaaactttttcattattcttatatctgttatgctgatctgtgatcagtgattttttaaatcttactattataattgctttggggtgccaggaactgcacccatataagaaggtgaacttaatcgataaatgttgtgtgtgttccaacagctccactgaccagctgttccccatctatttccctctcctaaggcctccctattctcttagacaatataatgttgaaattaggccagttaataatcttacagtgacctctaagtgttcaagtgaaaggaagagtcacatgtatctcactttaagtcaaaagctataaataattttcctttgcatttacaacttggctaactgtttggcctcttgtgccaaacagccaagttataatgcaaaggaaaagttcttgaaggaaattaaaagtgttagtctggttaacacatcaatactaggaaagtgaaacagccttattgctggtatggagaaagcttgcatggtctgggtagatcacactagccataacattcccttaaaccaaagcctaatccagggcaaggcactaattctctccaattctatgaaagctgagaggtgaggaagctgcagaagaaaagcttaaagatagcagaggttggttcatgaggtttaaggttggaagctgtctgcataacataaaagtagaacatgaaacagcaagtgctgatggaaaaggtgcagcaagttatacagaagatctagctaagattattgatgaaggtggatgtaccaaacaacagacttttaatgtagatgaagcagctttatattggaaaaagatgccatctaggacttccatagctagaaaggagaagtcaatgcctggcttcaaagcttcaaaggatatgctgactttcttgttaggggctaatgcaaaaaaaaaaaaaaaaaagcaaccaaaaaaaacaccttttttcaacatattaccactcattgacaaggcactaagtacccaagaacactgatggagatatacaaggagatttatattgtttttgtgcctgctaacacaacatccattctgcaacccatggatcaaggagtaattttgactttcaaatctcattatttatacattttgtaaggctatagctgccatagatagtgatttctctgatgtatctggtagaagtaaattgaaaatcttctggaaaggattcatctttctaattgccattaacattcatgattcaagcagatcaaaatatcaacattaacaggagtatggaagaagtcgattccagccctcatggatgactttgaggagttcacgacttcagcagagaaaatcactgcacatgtgatcaaaataacaagagaaatagaattagaagtgtaacttgaagatgtgactgaatttgaaactggcccaactggcacatagaactaatgtttactgttttttggataaacatagaaacttgaaactgaccctcttggtcttaaagcctgaaacttgcatttgtcttatctgagtttcttcctgaggaaaccaaccctcgggcctcccagatagttcaaggaatttaaactcaccagatcaccacatccaaacaatgggatgccagacccctcatccatcatgatgcctgtttaccaactcctcttctttatccctctgtaattcctgttttctggcatgtagttacatttcttcctgctatataaacccctaactttagtcagtcagacagatggatttgagactgatctcccatctccttggctgctgcacccgactacagccttcttccctggcaaaattcatcatcctggtgattggctgtctgtgtggccagcagcaggacctagtccaaacccctggcatttcagtaacagactttgattccctaactgggaatgcattgctcatggcttagttgctgtgggccaggagtttcagaagccctcctaagcagctgcccatcccttttttagccggaggtaactttcagtttctctctggctccgcagctgccagcactaatactagacagcaggatctgctcctctcattttgggaaactctgaaggaatttctgtgtgcaggttgaacaagcccaactgactgagagaggaagcacccctactgttttagtttgggccctcttggggcttgttggttggtacagcagttggattgtgttttggtgatggtgtgtgtgtgtgtgtgtgtgtgtgtgtcagtatagtcacaggaaatcagaatttgataaacaaatcatcttttataatactgtttggccccactattctttggagtctggaacagcttcacctctccatgggtctcattttgttgttgaatgagaaagcaggatagaatttcatgtattcaggcttttatgctgttgttctaagcagaatcaggcctggttaatacgtgatgttcttctgtggtactgtttggccctggagttctttggagtctaaagacgtttggcctttaaaaatcaaaatgccatggaaactgctttactccaaattttggttcacaaccataactggattacctaccagggcaaacaaaatttagcaatgtgaaaatgttcataaactagtgagcttgtattgctatcttatggctagagttccaaggtaaaagccattggaactttgtgcatgtatatacatgtctagatgtgtttatttgtatgtacatttattaggttatatgttgtgtcttccaaattggcttataattgagagtgcttaaattaaaggagcacataagttaaataaatatgtcctagcatttttcaagttcacatgacttgaatatatcttctttaataaacaagctggctttaaaattattggtaaaataaaaatagaaatgtctttaaaattgtcagcatacatttttgtctggattttacatttgtccatgctagatactttgaggtgtcaggatttggcacgaaaggttataaaactataaatctagccaaaaccaaaatgatctctgtttgtgtgacttttgacaaataagaccaatttaatgttgttggtttcacagctgaatcttctgaattattggtaaaaatacccatgtatttaacttaaagattcttacttaggtgcacacctactatgcacaggttataaaaatgaaatgacgactagctttgtctaatatctcagttctcataagttatgtagataaactgctaaaaacgaatgaaatgtaaatgggataaatgctgtatgtgaacattttgtgtaacttaaaatcttaagatcattttggatgctcattggatgcctgggtcactttcaattgtgaaagcattctgacatggggaaacaattttttaaagtgtggaatggttctcatctagaaaatgctaacatttgatagttcaggattttctgcttccttggttttcactaaaatttatggttactaagaataagaagtatagttaatagataattctgtatataaaatgtgctaaagaagatgtgttcctgttaagaaaaagaataattatgtttaattcggaagttgtctgaaggtttattcaaattatggacttgaaaaggttatttatgaaacaaggtagaaagaaaccaataagtaggggagagagatttgaagaaagttgtggatatgaagatgtatttttaataaggaagtttataaagaaagaataatttcatatgagaaagaaccttgtaaaataaatttttgtcctgagtaaaatggttagttattttaaaaagaaaaaaattaggacaaaatagaatgtccaagcatgtcatggatggtctgtgtaaatcatatacagttgtgtttttttttttctggttctctgtgtgtctatcttcatgcacatacaaagaaaatagaaagtttaaaaagtttagataataaaatatttgttaaaacctaataaaaaatggagaaatttggctaacattgctcatagttaaagctcttaattttgattaaggtaaaataggaaatattgtaaagaaatacattggcagtttggccattctttttcaatgtagttaagcatgaagccagatttaacatggagccaaatttcacataaatgtttgcattcctttacttcacaatgtatttgctatgctgcatagacagtactaacactaagtacttactagtcatgtgcctaaagtgaatttcttaattgcataaaatctatactggtattggtggacttaaagacattaatttgtataccaggaacaaaatatccctcatgtgttttttttaggctctgggtaatgctggagcctttaaggtgaactgagtaggagaaaacctgggggttgttttcttgtttgtttttgcttttcattttaattttgctatttgttctcctttgggttttacttatatatacatatatacatacctacacatatgtatgtatatatacatacctacacatatgtatgtatatatacatacctacacatatgtatgtatatatacatacctacacatatgtatgtatatatacatacctacacatatgtatgtatatatacatacctacatgcttagacattctattttgttgtaattttttttctttttaaaataagtaaccattttacttaggacaaaaatttatcatacaagatatacatatgtatatgtatgtatatgtgtatatatatgtgtgtgtgtgtgtgtgtgtgtatatatatatatatatatatatatatgctgtctagtttctaatagagaactttcatttggttctatgaatagtcttgtgtttcctgtgcatttccaaaaatatatcatttgctctatttatctgaaattactaagctactttattaagcctctaaaaattgatagaacgcactgttcacttaaactttgattgattttgctcacctctcatgatctagagaggtataagagctttaaggttcctggcaaaaaaaatcaaataaaagatttatttttgtaagttctgaacagaaatagtacattggtttgttatttggaaatgtagttgaaagtgtttaaatggtgtttatctccaagttaattcaattcaattaataatttgggttggtttcagatcttttccttcaggtattgaggaaaaatcgtgatatgtgtacaaagttttaatgttcatgaaagattggccttgtccttaaggaaattacattcactgctatttctctcagactactttagttgcatttaccattattaaaattaaatgacattcacttggattaagcagtaataataaaaatgtgaggctttctagtgatatttggtcccaagacttttatcactgtcaggccctcatatgtgtgcctgaaaacaaaatatgtacaagtgttgcagtggtttgaagattccagtggtgaaagttactgaatcagttgtcagtactgtatctagaaaccaatcatggaaatgtgtgatgatactcttttaaaatagctgaaaagaaattattctgtacctgttcttactctgtccctgttttgttggataatatttgagtgaaaggaacttatttatcctcacactgaattccaaaactgatatttgcatttaccattttttaaatgatggagagaaaagttaattgtcttacttagatatgtttgccataggacctataacatttctgatgctttaggtcacagttccatcactaaaatgctaccaattagatatgtgcaaggagtaacctaatcactttattttttggtaattttatacttttttttgagacagagtctcactctgttgcccaggatggagtgcagtggcatgatcttggctcactacaacctctgcctcccaggttcaagtgatgctgcctcagcctcccaagtagctgggattacagacataaaccaccacacatggctaatttttgtatttttagtagagacggggttttgccatgttggccaggctggtctcaaactcctgacctcaagtgatccacccaccttggcctcccaaagtgctgggattacaggcatgagccacttgtgcccggccaatataatgtttttaataatcttgtgcatgaaacaaggtttgtgtatatagaaccatcagaaagcaaaggtgtcactatctcagccatccatgtggataatctgtggttgtttggcatccattattcctaactctgaatttatatgctacgaataagcaatcactttcttacacttgtttacacacaagtacttaacagtaaaaaatatgacatatcattcatacagtgaaaacataatgtgttcaagtaactaagcagcacagtagcaccaccagaattcctgtgtcagctgttcaacaacagcaacaacatacaataccacattttcaatctccacgtatgatgctgtgtttccattaaaatgggtactgtacactgtattttattttttaggtgagaagaaataccacaagcagtggagaaaccaggaagtaggccctttagggatgaggaggcattctgctagatgactttttaaagtgtttcctccagagtaatttgtctcattaacaacagtttttctcttcttgattttataaactgacatgatttcttatttcttatttgttatgaatgcatactgctctagtcctccaataagcccatcatacattttcaccatatcatctaaaggcactttttctgcagtgttaataatgtcatcttcatcattgctatgatcatatcacctttattcaggatcatgttgactcttccaccactggttaatgaatgaaaaactggattgttcatcattactgagcataatcacaggccagaggttgtgccaggcatgcacggctgtgtccttagtcactgttttccaagcattagtaacagtatatatggtatcatttatgcccaactccttttaaaaaccttccacacccatacctttcttcattgctactagcatgctgttcgataaagttttttttttaaatatttactcttcagtgagttaaggataccccagtcacatggctgagttaatagagtcacatttgggggaaatacatggtataaacattatttttaatgagaatttcagctgaggaacgagcaaaacaattgtcaaggaataactaaatcttgcaatggtcacccagtccagcttccctgaagtgagcacaagctgctggtacaaattgtgaaaccaatcagaaaaggcatcgctagcgatccatgccttattgttagcataataatggacttaaaagaaattcactccttgaaaacaacaaaaatgcaagcttttgcctaccacagtaagctgacagttatgtgtgcctgtggcattagcacattctagcacagttattctgtccttggcatctttaactcctgcaggggctgtctcctcctctgtagtcagtgtatttctggggcagtggtttgaagtgctgcaggcagtaactactggagaccaaatcacagtgttttaatttgtgacatgttagagagaataataggactttctgcagtattagtaaactgaagcactaatttctaaatgttctttttttatgtctttaaatgtttcattaaacattggcttctgtttttagcataaatgcatatattatactcgatcatttatattgtagatagaaacttattttacagcaaagtagtctgtctgcatattatgggtagagtgcccctttattgtaattttatttctatattgcttttaaagccttttgatgatcacttttggttaaatgaataactgttattttacaatgacctgtgattctgttttaataaaacgtttcaagtcttttaatttctttgataagcatcctattaactaatccttgtgctgttaagttacagggtcttgactcctgggtctgaaaaaggtgccgatacctgctaaatcttgaacattgacaccagtcaaagcctcatctttagacccaggagaaggcagcaatcaaaatgaactgctttcatgagacacagggccaggaattaaaactatccaatccatctaggcccaggaactattgcagaaggggggcaggcacatgagattgtaagggccaattttgacaaataaaattagttatgtatgttcttttgtggtggttgtatgtgtccttatgtaaccttcaaaagatctcactgttctaggccgatgctgaacatacaactcagcttggcgggcaggggtgcagggaactgggcttccattcttaaatggcaaaggaaattcctttgattcataagcaattctgtaaccttactttttggcttttagtttttggctattatgttgcttaaagggttttaagtgttaatgagtgcctgcccccctccattcttgtctggtctacagtgtttaattggctgttagtcttttgactctatgtcccttggctatagaggtcccactgagggatgagatggacctaaaacatgtagccacaccaccttggcaacactatgggacaaaataaattcctaagccccccattgactgagtaggcccacttgtggccaaggggaccccagttgccaagagataaatcttaactgggaaaaggtcttgtcccttgccctgctgaggatgtgggtagcccctaaaagtggattggcttttagagcctccaaaatgtatggaagaccatttctctaacctccagactccttgacactttagtatttttcctcctctgacacagaagctaggtcatatataaaacaattaggaaatatattaactagtctctaagtttgcttccaacaggcttcagttccctagagatgtacctctccactttttgaaactgggagatcccaagtcctgctgaagacctggaaatcccaccaagctgtagatgagctgcaaccacaatgggtcagccctttggaggtgctgctgatcactcactcatctgtcaagttagctggtgctaagtcgtggattcactatactcgggtaaaaccagtccctctggaatctctcccagggaatcagtcatggtcttgtgaaccctcagatggccttaatatctaaagtccagtgaaagaccctagttaaaaaatcataaagggaacatgtagctttcgcgattattttattggattccccaagggatccactccatatcctttggtgttttaaaatttaggttatccatgttattaatcatcctagtcaatgtgacttaaaatgttgttctaaaaccattaaagtatccaggtcctggtgttccaacaagtcagatgctgaccaggtacttatgaatacttccaattacaggggtaacattttcattcctcatcagtatcatataatgcccttcctcagcataaagcagtcagaaagatcaaccaccagattccccatgattgaggaactgataagtagaaatagaggactgaaaccggccaattgtctcacagaactggtgtttaccgtcttttggataaacatagaaatttgaaattgaccctcttggtcttaaagcttgaaatctgcatttgtcttatctgagttccctcctcaggaaaccaaccctcaggcctcccagatagttcaaagaatataaattcaccacatcactacatccaaacaatgagatgccagacccctcatccatcatgattcctgtttaccaactcttcttccttaaccccttcttcctgttttcccatatgtagttacatttttttccctgctatataaacctctaattttagtcaattgaggagatgaatttgagactgacctcccatctcctcagctgcagcacctgaataaatccttcttccctggcaatactcaactcagtgattggctttctctgcagccagcaacaggacctagaccaaacccctgctgttttggtaacaaattgctgcaatctcatgataaaacttaaatggatgaggcattgcttctaatggatgagcaaagaatggtttattgagatggaaactacttctggtaaagatgttgtgaacattgttgaaatgacaacacaggatttagaatattacataaacttagttgataaagcagcagcagaatttgaaaggatttactccaattttgaaaaaagttttactgtggtgggtaaaatgctatcaagcagcattgcatgctacaaagaaaccttgcatgaaaggaagagtccattgatgcagcaaagttcattgttgtgttattttaagaaattgccacagccatccaactttcagtgaccatcaatcaccctgatcagtcagcagccatcaacattgaggcaagaccctccaccagcaaaaagattatgactcactgaaggctcagatgattgttagcatttttatagcattaaagtatttttaattaaggtatgcacatttttagacataatactattggacactttagactatggtatagcataaacgtaaattttatatgcactgggaaaccaaaaattttgtgtgacttgctttattgtgatggtctggaacagaacctgcaatatgtccaaagtatgcctgtatatatttctctggcttgtcagcaggtggagttgatgcagacaatgcagaagttcaggaaccatgggtccaaaagccaagttaaagaagaaattaggatgaaaaaaaaaaaagaataaatcaggatgacatccagatactaaatatatcaagagatcaaaaagggtggcatatactctaatcactgaaaggaaacccaagtattgcatagcaccaacaacttcagtgtggcttctgcaaagtaaggataatactagaatttaacccatgctgtggtcagaattaaagaagctaatgtatagtatgtaaaggggctggcaggtaatggatgatcaatgactggtatttattatcactattattgcatatttgtgaaattttaaaacagttactatataatagtgtttctttcaccataagacaactacagttgagaaggatgtccatccttgggctcagccagtgaattgattggggttcaaccaggagagagacagaaaacacatagtaatttaaacaagaaatgtttattataaagaattattaactatgtatagtaaattaactactaagaaggaatttaaaaaggattccaaagaatatcctaggactaagggagagtattcaaggaaggaacaaacttggaagggtgggaggtgcttccccagggctaggatttagatgtcattgaagagggtatggtttcagccaactaaatgatggagaagtccactaggctggaagcctcctactggtctgaagatggcaggcaggaaagcatccccttgaatttctaataaattctctgggaaactgcccaggagaaggggttgaacatgctggaaagccagctagggcatcttcacaactctccaggaaactgcccttttaccaggacctgctgaatttgcctagaaaccaggtggggcacccacagaacgcacagggaatccatacacaggggaggggaatgctgctgttactcacctctagaaaggtacataagatgggggtggaggggaagggttgctgctgaaagcagcaggaatgaccttcactgggtgtcccacacatcagccaagtgccccaaaaagaggaaaaggcacagcacaccaaaaccatgaacagaagccctttcatcctccagagtccctccaataccctatacaggcaaagcttaagatcatgccagctggccaggagacaatgttccaggatcacaaccaggcagcaaaagttggatttggggctgagaggcaacatgttgatacctggcacagctagaaaagcagtaaaatgtgatggccaagagtggaggctctggagctcaactgcctgggttgaaattccaactctgccacttactgtctgtgtgattcagcctttctgtgcatcagtcccctcattctgtaaaacggggatacttgcagaagctacttcatggggctgttgtgaagatctaatgggagagcatgtgttaaatctgtgtcaatctatctgagtctttgtgcacagtgcctggcatatagtaaatgctttatgtaaggcatctgtcagtatcatgattatcattatattctaactggctaggacacatactgaaggctgtattctttattttttattttgtataaatttatagggtgcaatttattttttatttaaaaataaagaaaactattgggaaaaaaaacacaattacttttgcacaaacctatacatgcacagatcctgtagggtgaagtcagggcttctagtgtatccattactgaataacatacattgtaccaattaagtaatttcacatcatccacctcccaccctctaagcctttctaatctccattgtctattattacatgctgcatgtccacactccacattcatgtatacaccttacttttttttatttgtatcgatttacggggtacaagtgcagttttggtacatggatatgttgcatagcggtaaagtctgggcttttagtgtaacaatcacccaaattgtgtccatggtacgcactaagtaatttctcacgtctcactctcctcccatccttccactcttctgagtctccagtgtctattattccaccctctatacccatgtgtacacgtatttagctcccacttacaagtaagaacaagtgacatttgattttctgtttctgagctgtttcacttaagataatggcctccagttccatccatgtttctgcaaaaggcatgactccattcttttttacagctgactagtactccattatctatatataccacattttcttttttttttaattttattttaggatcagggatatgtgggcaagtttgttatatagaaaaactgcctgtcatggaggcttggtgcacagattatttcattacccaggtgataagcatagtacacaataggaagctttttgatcctcatcctcctcccttccttcaccctcaagtaggccctggtatatgttgtccccttctttgtgtcaatgtgtactcaatgtttacctcccgcttatgagaatatgtggcacgtagttttctgttcctgtgttagtttgcttaggataatgacctccagctccatccatattgctgcaaaggacataatcttgttgctttttatggcttgtagtattccatggtgcatatgtaccacattttctttatgcagcatactatttttttattattttattttaagttctggaatgcatgtgcagaacgtacatgtgtgttacatatgtatacgtgttccatggtggtttgctgcacctatcaacccatcatttaggttttaagccccgcatgcatcaggtatttgtcctcccctcgccccccacccccagattggccccagtgtgtgttgttcccctccctgtgtccatgtgttcccattgttcatctcccacttatgagtgagaacaggcagtgtttggttttctgttcctgtgtaagtttgctgaggatgatggcttctagcttcatacatgtccctgcaaaggacacgatcttcctttatatggctatgtagtctactatttttttatttgtattttactttaagttctaggatatatgtgcagaatgtgcaggtttgttacataggtatacatgtgccatggtggtttgctgcactcaccaacctgtcatccaggttttaagccccgcatgcattaggtatttgccctaatgctctcccaccccttgcaccccacccccaacaggccctggtatatgatattctcctccctgtgcccatgtgttctcattgttcaactcccacttataagtgagaacatgcggtgtttggtgttctgttcctgtgttagtttgctgagaatggtggcttccagcttcatccatgtccctgcaaaggacatgaactcattcttttttatggctgcatagtatcctatggtgtatatgtgccacattttctttatccagtctatcattgaaggacatttgggttggttccaagtctttgctattgtaaatagtgctctaataaacatacgtgttcatgaatctttacagtagaatgatttatagtcatttgggtatatacccagtaatgggatttctgggtcaaatggtatttctggttctagacctttgtgggcatttaggttgattccatgtctttgctattataaatagcacagtaatgaacatatgcatacatgtgtctttagggtagaatgacatattcctttgggtatatacccagtattaagattgctgggtcgaatggtaattctgctttgcaaaaatccaactttttattttgttgatcttttgtattttttgtttcaatttcattaatttccgctttgatctttattatttcgtctatgaattttggattttgtttgctcttgctttcctagttatttaagatgtattattaagttgtttatttgaagtttttctacttttttgatgtgggcatctaatgctatgaccttccctcttaacattgcttttgttgtatcccacagacttgggtatgttgtgtttccattgtcattcatttcaaaaacattttaatttctgtattaatttcttcattgacccagtggtcattcaggagcatattgtttaatttccatgtatttgtatagcttctgaaattctctgggtattgatttttagttttattgctctgtggaaaagatactcaatgtgattttgatttaaaattttttttttattattgtactgtaagttctagggtacatgtgcacaacatgcaggtttgttacattggtatacgtgtgccatgttggtgtgctgcacccatcaactcgtcatttacattaggtatatctcctaatgctatccctcccccagccccccatcccacaacaggccctggtgtgtgatgttccctgccctgtgtccatgtgttctcattgttcaattcccacctatgagtgagaacatgtggcgtttggttttctgtccttgtgatagtttgctgagaatgatggtttccagcttcatccatctccctgcaaaggacatgaactcatccttttttatggctgcatagtatttcgtggtatatatgtgacatattttcttaatccagtctatcattgatggacatttgggttggttccaagtctttgctattgtgagtagtgccacaataaacatttgtgtgcatgtgtctttatagtagcatgatttataatcctttcagcatatacccagtaatgggattgctgggtcaaatggtatttctagttctagatcgttgagggatcgccacactgtcttctacaatggttgaactaatttacactcccaccaacagtgtaaaaccattcctatttctccacatcctctccagcgtttgttgtttcctgactttttaatgatcgccattctaactggtgtgagatggtatctcattgtggttttgatttgcatttctctgatgaccagtgatgaccagcattttttcatgtgtctgttggctacataaatgtcttcttttgagaagtgcctgttcatatcatttgcccactttttgatggggttgtgtttttcttgtaaatttgtttaagttctttgtagattctggatattagtcctttgtcagatgggtagattgcaaaaactttctcccattctgtaggttgcctgttcactctgatggtagtttcttttgctgtgcagaagctctttagtttaattagatcccatttgtctattttggcttttgttgccattgtttttggtgcttaagtcatgaagtctttgcccgtgcctatgtcctgaatggtattgcctaggttctcttctagggttttatggtttaaggtctaacatttaagtctttaatccatcttgaattaacttttgtataaggtgtaaggaagggatccagtttcagctttctacatatggctagccagttttcccagctgggaaatagggaatccttttcccatttcttgtttttgtcaggttttttaaagatcagatggttgtagatgtgtgatgttatttctgaggcctctgttctgttccatttgtctatatctctgttttggtaccagtaccatgctgttttggttactgtagccttgtagtatagtttgaagtcaggtagcatgatgtctccagctttgttctttttgtttaggattgtcttggctatgtgggctcttttttggttccatctgaactttaatgtagtttttttccaattctgagaagaaagtcattggtagcttgatggggatggcattgaatctataaattaccttggtcattatggccattttcataatattgattcttcctatccatgagcatggaatgtttttccatttgtttgtgtcctcttttatttcgttgaacagtggtttgtagttctccttgaagaggtccttcacatcccttgtgagttggattcctaggtattttattctctttgtagcagttatgaatgggagttcactcacgatttggctctgtgtttgtctgttattggtgtgtaggaaagcttgtgatttttgcacattgattttgtatcccgagactttgctgaagttgcttatcagcttaaggagattttgggctaagatgatggggttttctaaatatacagtcatgtcccctgcaaacaggaacagtgttacttcctcttttcctaattgattaccctttatttctttctcttgcctgattgccctggccagaacttccaacactatgttgaataggagtggtgagagagggcatccttgtcttgtgccggttttcaaagggaatgcttccagcttttgcccattcagtatgatattagatgtgggtttgtcataaatagctcttattattttgagatactttccatcaatacctagtgtattgagagtttttagcatgaagggctgttgaattttgtcgaaggccttttctgcatttattgagataatcatgtggtttttgtcattggttctgtttatgggatggattatgtttattgatttgcatatgttgaaccagccttgcatccaagggatgaagcccacttgatcttggtggataagctttttgatgtgctgctggattcggtttgccagtattttattgaggattttcgcattgatgttcataaggaatattggtctaaaattctgttttttgttatgtctctgccaggctttggtatcaggatgatgctggcctcaaaaaatgagttagggaggattccctctttttctattgattggaatagtttcagaagaaatggtaccagctcctctttgtaccctggtagaattcggctgtgaatctgtctggtcctggactttttttggttggtaggctattaattattgcctcaacttcagagcctgttattagtctattcagggattcagcttcttcctggtttagtcttgggagggtgtatgtgtccaggaatttatccatttcttctagattttctagtttatttgcacagaggtgtttatagtattttctgatggtaatttgtatttctgtgggattggtggtgatattccctttataatttttattgtgtctatttgattctgctctcttttcttctttattagtcttgctagaggtctatcaattttgttgatcttttcaaaaaaccagctcctggattcattgatttttttgaagggttttttgtgtctctatctccttcagttctgctctgatcttagttatttcttgacttctgctagcttttgaatgtttgctcttgcttctctagttcttttaattgtgatgttagggtgtctattttagatctttcctgctttcccctgtgggcatttagtactataaatttccctctacacactgctttaaatgtgtcccagagattctggtatgctgtgtctttgttttcactggtttcaaagaacatctttatttctgccttcatttcgttatttacccagtagtcatttaggagcaggttgttcaatttccatgtagttgtgcagttttgagtgagtttcttaatcctgagatctaatttgattgcactgtgatccgagagacagtttgttgtgatttctgttcttttacatttgctgaggagtgctttacttccaattatgtggtcagttttagaataagtgcgatgtggtgctgagcaaaatgtatattctgttgatttgaggtggagagttctgtagatgtctattaggtccgcttgttgcagagctgagttcaagtcctggatatccttgttcaccttctgtctcattgctctgtctaatattgacagtggggtgttaaagtctcccattattattgtgtgggagtctaaatctctttgtaggtctcttaggacttgctttatgaatctgggtactcctttattgggtgcatatatatttaggatagttagctcttcttgttgaattgacccctttaccattatgtaatgaccttctttgtctcttttgatctttgttggtttaaagtctgttttatcagagactaggaattttaaaagtttaagacttgttttgtggactaacatatgatctatcttcgaggatgttccatatgctgatgagaataatgtatattctgaagttgttgtgtaaagtgttctgtaaatgtctgttaggtccatttggtctaaagtccaatttaagtctagtgtttgtttattttctctctatgtaatgctgtgagtggggtgttgaagtctcccactattactgtattgctatctatcactttctttaggtctggtaatatttgttttatgtatctggatgttccagtgttgcatgtataattagaattattatatcctcttgctgaattgattcagatggctgatccctcagaggggtcacttgctacttgctgacccctcagagatgatgatgggggctcctggtcattctgtgtcataaatactgctagcctacagagcttttctgagaaatctaggatcagtgggaataagaagactctagatgagcccatgccacaccttagtatatatgtagcaagacaaaattatccattgttcatttataattccttcttgccctctagaagattggctttcatacctggctatagcatagccattgtatgtagaggctgggagagaagagcctggacttcaataaagtagcatgctcaaggacatgtggaatgaaggctcttccacttcccctgggaaatcttcggtgaaaccagcattgcttggtaatgctttggatgcatgtgccttctttcaggaaaatgtgaaaagaggctgggtcttgtgtggggtgaatgtttgaattgccagggcctgggcctggggctctgaaggggaatgcacacactaggcagggacatgggacctgtacaccaagtcaattgtgggatctcatccatgggtcatggtgtcatggccatccttctgaccacaatgactacaaatgtctcctagtaagtgggtggtatgcatctgaaacatgggtgaaagcatggcaggaggtggctgaattgtgaactttccactggaaatatttgagggctctgggaaagtgaagcaagactgatagtcagcaccagtttcttgacatgcagtgtccccatatactgggaaaccaaataggcatgcttgtgagaccctggtactgacaacaatgggcacatgtagtagtttcctatggctgctgtaataaatcgtcacaaacatagtagcttaaaacaacacaaattcattctcatacagttccagaggctacaaatctgaactggtttccttctggaggttccaggagaaaatcagtttgcagtttctagaggaggccatctgcattccttggctcaaggccccttcctctatcttgaaagctatttgcagagcatcttcaaatccctctttgctcttgtcttatgctctctgattctgcctctattgtcacatcttcttcttctttatttatttatgcatttattttttaatcaataggattaaaaagcccacaacatctccttctttgactctaaccttcttgcctctctttttttttttttttttttttttttgacagagtcttgctctgtcgcccaggctggagtgcagtggtgcaatcttggctcactgcaagctctgcctcctgggttcacaccattctcctgcctcagcctcccgagtagctgggactacaggcgcccaccaccacgcctggctaattttttgtatttttttagtagagacagggtttcaccgtgttagccaggatggtctcgatctcctgacctcatgatccaccctcctcagcctcccaaagtgctgggattacaggcgtgagccaccacgcccagccgcctctctcttataaggataccattttaggtattattacatttagggctcctggattattacatttaggattacatttagggctcctggataatccaggattatctctgctatcaacatccttaccttaatcatatgtgcaaagtcctttttggcaggtaaggtcacatattcacaaggtctgtggattaggatatggacatcttgtgggggtgccgggggtggggggggcattattctgccaaacatagtatttgtcctcagtgtctccttatatgaactggagtttggccagttcagagggcacctgggtctggaacttggagctttctgaggtaccatcactgggggctggacaaatagttctactgagataataataacaagctctggtagaagtctccattttataggtgaggcacagggcatttgagtaacttgttttagttaatgagaggcccagtgagggtttgaatgtaaatatacccttccccaacacaacactgttggcctgaggggccaggtgggtcccagtggcagagacctctgaggtgagtagtcctggatgaagtgcgtggcattacttctagcctcaagaactgtgacagaataagtttctgttgtttaagtcatccaattttggggtatttgttgtggcagctaaaggccaacctggtagcacatccacccacacttgcatcaagtttccaagtccctctggtgtcagcaggagcaagacagttgctctgtgcatctgtgaaaagtcactagatgtgcctctccctatacatggatctcctttgagtcctgaagggctggaggggtccaggtatagacgtgtgctcctgaggtcctcctggcatgagccctgtagttgcttgaatagtggctcccaaaagttatgaccatcaagagcccgtgaccttatttggaaaaagtgtctttgcagatggaaataaggatcttaaggcaaaattgtcctgttttatgatgagctctaaatccaatgacaagtgtccttacaagagaagagaaggcaatatgaagatggaggcagagattggaaaacgccagtgattgccagcaaaccatcaggagctaggagagaaacaaggaacagatgctctctcacaacctccagaaggaaacaactctgccaacaccttgatttcagacttctagcctccagaactgtgagagaataatttctgttgtttgaaccatccaatttgtgggtcttcgttgtggcagctaaaggaaaataatacaagcccagaagctgaggcattgactgtgagcccacaggcaagaaggagaaattctgtggcctgatgagctcctgaaccttccccttgctggaatcaaggactggcctccatagagcaggaccagtacatactcgggttttctataggcaccagaaagggaggagcagaccagctgcagaaggagccaagtctaagtcccccagcaagctagagctgggcactcacaaagcaactcacctagaacagacttcagattccatttatctagaaatgtggcttgctaatttcccccgaagcggggatgagggggtagccctagctagagcttgtaccctgggtgcaggcacagttctcaggagtggcaattctcagttctccctgaggcttggggcatgctgaccaccagagggtattgcggcataggcagaggtggaggaggacgcagtctgaagcttctgcctatcagttcctgagtggggcaactgtggggctcggagaatattgccccatcacccctcaggaccaggtgaatgaagcacaggctgaggaggaaagcctggcagtgggtatctggggcctgggctagccatcagggtcccttccgtgtggatccagtgttccatgtcagcccaagctaaacaacctggaacctggggggaaaggttttggcaaaatgatggtgagcagagtgacctgaggacatttccatgtctgagatgaagtgaacttggcaacgggaagggttggctgagaagaagctggcagcaattagccagggctcttcccaaatgcccatggccactggcctgagtgctgggaggagaaaaagttgccactgcagctcccctcacccacccagcctgaaagcacgtctcccagagatggaaaaagactacctgcagtcttaccctggtagatgttccaggacttgagaaatgttactctccaccctgactaaactcagaaagtcatggaagtcagctcttcgaggcaattgcagagtatcaggactcaggggcctgtacctgagccagcttctcacagaaactgcctggctgaggctagtgatctgcctggcaccaggagagaggcccatgtcttctccatggtcagaggcagcagcagtaagatcaacaccaaagctcagcctgtcctggggagtaggtaatttgtccagagattcagcttccacagataatctgtgtgagtagccaaaatcaccacccagatgcttttcaccaaagccatcactccaagagacagcaggagcctccacagccctggaagcctatggtctgataacaatggggccattcagctgtggtgatggatgtttgaggcaacacagccaggcaaacaccagtgtctgatcaatatgcttaccactccagcgtatgctctgaaggagcaaggtgtgaggcatggcatgatataatttccgcaagagccagctgtaagtcctggtggggaaagcaagcacaccatgctatttccaccttagcaagccacccaggcctatttgacactcagcacatggctctggaggccactgggaaccctgagtctgtcacagtattctttaatggtactggtgtcttccaggatgccaccactagttataccagaactcagtccaaaggcagacctggagaaccttaaagactacaataccaagtcctaactcccccttcttcaggacaataccactgatgtcatcacagatatgaccacctttccaaggtcacaacaccatcttagatggagaggtatccttgccacgatcgcatacttcatcctgagtactgggcctctatgagttccagacactatccttctctccagtaggggtgtcttgtctccaggggaagcctgtcactcaacctccccattctgcaaagtcctcttgaatcacatccccattctgcaaagtcctcttcatagaccttcccattcacacacacatatctaagacctgtcacccccttctccatccctggctgaaccaaagacaatatagtcaggtaggcctgaattaggtacccagcaccaccgtaagaatggtctgcacctaacagaaaatagtttctctccttaccagcaaatgaatacatccagttctgggctcatcatgagaagcggtagagtgatggctaagagtgtgactcttgacccagcccaactgcctggattcaaatcctgactctcccacttattagctgtgtgagactgagcaaagtacttaacctctctgcgcttcagttttctctttaaaaaagcaaagatggtatcagtacttacctcacaggttcattgtaaggagtacgtgtgtatgcacacacaacagaatctcaagacactgctgccactatcccccacatctcccgggtcgcacagctgtcctgcctatctatctctgcccaaattggtctgagatgactgattgtccccttcacctatgacacaatatttcacagcagccatgacttccctgaagcctgagtgccccctctctagtagcctactaatacctggagaatctgtgtaccctccccaacaaaaacccctgaggatcccctccacacctcaaagcaaggcagagcatgtgcccataggtaccaggcacataggtccattggggactttaaggatcttggggacaagcacccatgcagatcctcctgctacaactgtcctgtcaactccatcctctgccccataccctgtgtcctcttgacaaccagagatcatgctggagaaagcagtgagcactaaccacctactcctcagtcctctccaatactgttacccagagcaatggaagagggtgggtctgagaaacaatggtgggaacctgtctgccagctccaaaagcccgtcactccactttacctctgtcagctgggcccagcaagcacacagatggccttattcatgtactattcactcactcattcattcaatggtagcattaagctaggcacttttctagttactaaggatacagttatgaacagaagataccaaatctcttccctcatggagcttctctttagttaaggcagacagacaattaaataagtaaaatacatagtatgtcagatggcaagatgtgctatggaaaaaaaattaggcagggtacaggcgtggcaaggagttggaattttaataggatatttggaaaagggcccatgagtgacatttaagcaatgatttcaagaagctgagatagcaaccctggcccacaacctgcacctcacgccactaccactgtcagcatgaatgcatgcaaggaggccagcagccctgtggcagccagtatcccatccccatgcagacattgcccccattgcaaaggcacacaccgaggccagtgacgctgctcaagctacagccgctgctgccaatacatgcacggaggccagcagtcccgtgcctgccagcgcccaccccagccaatgagcgtgtaccccaccacgctgctgctggcacatgcaaatgagcacagatcttgctgccactgtcccagtgaagtactttggccagcaccacccattggagtgttgtggacagtggtccaggaacacctcggcccttccagatcagcaggttcctaactttgaggggccagagaacaaacctggggcctagtaccagcccccagaattagcgcatgcagtccaggagtgctgagctgagccttggccccctaaaatcttccagaaataaagccagttgactaaacccaccttatatccttgtataaggtgaacccacctcatacaatcaaatgcccaagggcatcaaaggagataaaagggaaaaaaagcatccaaaggacagcagtgtcaaagattgaagggacatcagcacacacagatgagaaagagccagcacaagaactctggtaactcaaaaagtcagagtatcttcttacatccaaatgactgcactagttccccagaaatggttcctcaccaggttgaaatggttaaaatgacagaaatagaattcagaatatagataggaatgaagatcattgagatctaggagaaagtcaaaaccaaatccaaggaatctaaggaaagcaataaaataatacaggagacgaaagacaaaatggccattttgagaaagaatcaggcaggtgtggtggctcacacctgtaatcccagcactttgggaggccaagacaggtggattgcctgaactcaggagttcgtgagtagcctaaccatcatagcaaaatcctgtcactacaaaaaagtacaaaaaatagctggcgttgtggtgcacgcctgtggtcctgactactcaggaggctgaggtgggaggatcaactgagtccagagaggtcaagactgcagtcaaccatgtttgcaccactgcactccagtctggatgatagaccctgtaagaaaaaaagaaagaaaagaaagaaaaaaaagaaaagaaaagaaaaaaaggaaagcaaagggaaagagaaaggaaaggaaaggaaaggaaaggaaaggaaaggaaaggaaaaagaaaagatccaaactgatctgatagagctgaaaaactctcttcaagaacttcaaaatataattacaagtattaatagcagaatcgaccaagctgaggaaagaatctcagagctcaaagaccagttctccaaaataactcagcagacaaaaataaacaaaaaatattaaagaagaacgaagaaaacctccaagaaatatgggattacataaggagaccaaatgtacaacttattggtgcccctgaaagagagggagagactctgcttggtgaggcccacagcttcagtctccctgtgacctgcagatactgggacatctgtattgaggatactgggacatcctggaatgtgggaaatgatgacaggggaggcaagatggctgactagatgcagctaggaggaacatctgccaccgagggaccaagacaccagtaagactggcacactctgagaagatcattagaaggaaggcattgagagggaggacacagatgctgtgctgaagcgggaggaagttgggagccgtgcacagactaccgcacaccaggattcgttcctggcccccagtgacttctggggtgagttgagcagatgaggaacgacccactctctccacggacttctggaatcctggcagcaggagatcccacgactggcacagacacttgagctggcagggagaactgcttggagaagtggtaggggcaggactccagcctgtgcagagcccagagagtttggtgctagaacatctgcagggaaacatgaccagagatgtccatcccccaaagcactcaccatgctcccttcagagattccagccttaggtgaactgtcagacccaaacagagcaggacaatcttgcccatgagacagggctagtctgacctgagcacccttctgtttgctggcctctcccaaggccacaacctggccatgcctgcttgcagtgaagcctcagatgcccaaccagggtgcctcccagggaaccacatcatagcttctgtgctggcagaccacacctgaccatcagagagctccagcagagtggcccctgccgacgtgcaccagcatacccgcatccttctcccactgcagcctcccatgtgccactttgctggcatgcactcacccatggccacttcccccattgctttgctggtgcacatgtgaatggacaggcctcgtcttttcttctgcatcagctcatgggtgcacgtgcacccatggtgccattgccactggcatgaatgcacccactcccctgccactgtgccaccttgccaccattgccagcgcatagactcacaccagtggccctgcccccatcccatgccacaaccaccactggtctggatgtgggcacaaaggttggcagccccacaccggccagcacccattcccccacactgaaactgccatgggtgcaaatgggcacatggaccccagttgccacgtccccccactgctagctgccactgctgctgttgccaatgactgcaaggaagctggtaatcccagacttatcagtatcccaccccaaccaatgagcatgcaccccactgcactgccattactgtaagcacattggaatgcacacagatctcactgctaccacccaatgaggtgctttggctggcaccaccctttggagttctgtggccagtggcccaggaacaccttggccccttcaagcacagcagggtcccaatgttgagggaccaatgaataaagctggaggcccagtaccagccctccagagttagagcacacagtccaggagtgctgagccaagccttgaccttacacacacacaaaaaatctaccagaaatgaagctagtctattgaatctatcttatatcacaattaaatgctcaagggcatcaaaggagataaaagcaaaaaaaaaaaaaatacatccaaaggacagtaatgtcgaagattgtagggacatcagcccacatagatgagaaagaaccagtgcaagaactctggcaactcaaaaagtcagagtgtctttttacatccaaacgactgcactagtttcccagaaatggttcctcacttctgttgaaatggctaaaatgacagaaatagaattcagaatatagatagagatgaagatcattgagattcagaagaaagtcaaaacccaatccaaggatcctaagaaaaacaataaaacaatacaggagatgaaagatgaaattaccattataagaaagaattggccgggtgcagtggctcacgcctgtaatcctagcactttgggaggccaaggtggccagatcacctcaggtcaggagttcgagactagcctggccaacatggtgaaaccttgtctctactaaaaatacaaaaattagcagggcgtggtggcaggcacctgtagtcccagctactcaggaggctgaggcaggagaatcgcttgaagctgggaggtggaggttgcagtgagccgagatcgtgccactgcactccagcctgggtgacagagtgagactccatctcaaaaaaaaaaaaaaaaagagagagagaaagagagaatcaaactgagctgacagagctgaaaaactcacttcaagaattccagaatacaattgcaagtattaacagtggaactgaccaagctgaggaaagaatctcagaacctgaagaccagttctctgaaacaactcagacaaaaatgaacaataaataataatgaacaaaacctctgaaaaatatgggatcatgtaaggagaccaaatttatgacccattggtatccctgaaacagagagagcaacttggaaaacatacttcagcatatcatctatgaaaatttccccaacttcactagagaggccaacattcaaattcaggaaatgcagagaacccctatgagatactacacaagacagccatctcaaagacacattgtcctcagattctccagggttcaaatgaaagaaaaaatgttaaaggtagctacagagaaggggcaggtcacctgcaaagggaaccccatcaggctaacagtggacctttcatcagaaaccctaaaagccagaaaagaatgggggcctatatttagcattcttaaagaaaagaatttccaaccaagaatttcacatccgaccaaactaagcttcaaatatgaagaagaaataagatgctttttgtgtaagcaaatgctaagggatttcattaccaccagaactacctttcaagaggtcctgaagagagtgctgaacatggaaagtaaagaccattactggctgctacaaaaacacacttcagtatatagataagtgacactataaaacaactacaaaaaatacgtctgcttagtaatcagctaacaacatgatgacaggaatgaattcacacagatcaatactaaccttgagtataaacacactaaatgccccagttaagaggtacagagtggcaagctgaataaagaagcaagaccctttttgcttcttttatgctgtgtttaagagacccatctcacatgcagtgacactcataggctcacaataaagacatgtagaaaaatctaccaagcaaatggaaaacagaaaaaagcaggagttacagcactaatttcagacaaatcaggctttaaaccaacaaagatcaaaaaagacaaagaagggcaatacctaatggtaaagcgcgcaattcaacaagaagatctaactaactatcctaaatatatatgcacccaacacaggagcacccaaattcataaagcaagtcctcagagacctacaaagagacttacatgatggcacaataatagtgggagacttcaacacccccctgacagtattaggcagatcatcgaggcagaaaactaatgaagatattcaggacctgaactccaacacttgactggatgcatgtaatagacatctatagaataccccaaaacaacaaaatatacatttttctcatttgcacatggcacatactctaaaatcgaccacagaatcagacataaaacaattctcaataaatttaaaaaaactgaagtaccaaccgcattctcagacaataaatcacagtgcaataaaaatagatatcaatactaagaaaatcactcaaaaccatataattacatggaaatcaaacaacctgctcctgaatgatttttgaataaataacaaaattaaggcagaaatcatgaaattcttcaaaactaatgagaacaaatatacaacataacagaatctctggaacacagctaaggcagtgttaagagggaaatttagagcactaaacacccaaatcaaaaagttagaaagttctcaaatcaacaagctaatgtcacaactaatggaactagagaaacaagagcaaaccaaccccaaagctaccagaacacaagaaataacgcaaatcatggctgaactgaagaaaattgagatgcaaaaaatgcaaaagatcaagggatccaggagttaattttttgaaaaaattaataagatataccagaaaaaaagagagaagagccaaataaacacaatcagaaatgacagaggacattaccactgaccccacagaaatacaaaagccctcagagactactctcaacacctcgatgcacacaagctaaagaacctagaagaaatgaacaaattcttggacacatctaacctcccaagactgaaccaggaaaaagctaaatccctgaacagaccaataacgagttcccagattgaagcagtaacaaaaagcctgccaatcaaaaaaaaaaaaaaaaggaagaagaaagaaagaaaaaaaaaaaaaaacagaaccagacggattcacagcttaattgtaccagatgtataaagaagagctggtaccattcctattgaaactattccaaacaaatcaaggaggagagacacctccctaactcattctatgaggccagccagtatcatcctgacactgaaacctggcagagatgcaacacaaaaagaaaacattaggccattacccttgatgaacatagatgcaaatatccccagccaaataatagcaaactgaatccagcagcaaatcaaaaagctaatccactgcaatcaagtaggctttatccttgggatgcaaggttggtttaacttccacaaatcgataaatgtgattcatcacataaacagaactaaagacaaaaaccacctgattatctcaataggtgcagaaaaggcttttgaaaaaaatcaatgtctcttcatgttaaaaaccttcaacaaatgaggcatcaaagaacatactgcaaaataataagagccatctattaaaaaatccacagccaacatcatactaaatgggcaaaagcaggaaacatcccccttaaaaactggaacaagacaaggatgctctacttagcattcctattcaacataatactggaagcctagccagaacaatcaggcaagagaaaaatataaaaggcatccaaataggaagagaggaagtaaaattatctctttgcagatgatatggttttataccaagaaaaccccataatctctgcccagaaactcctatatctgataacctcagcaaagtttcaagatacaaaatcaatgtacaaaaatcagtagcatttctatacaccaacaacatccaagaagagagtcaaatcaaagacacaatcccattcccaatagccacaataaaataaaatacctaggaatacagctaaaaagggaagttaaggacctcttcaaggagaactacaaaccactgctcaaagaaatcagagataacacaaacaaatggaaaaacattcatgctcatggataggaacaatcaatattgtcaaaatggccatactgcccaaagcaatgtatagattcaatttgctattcctatcaaactaccaatgacattcttcacagaattggaaaaaaaacaattttaaaattcatatggaaccaaaaaagagctcaagagctcaaatagccaaggcaatcctaagcaaatagaaaaaagctggaggcatcccgttacctgactgcaaactatactacaaggctacagtaaccaaaatagcatggtacgggtacaaaagcagacacatagaccaatagaacagaatagatgcacagaaataatgccacacacctacaaccatctgatctttgataaacctgacaaaagcaagcaatgagaaaaggactccctattcaataaatgatactgggataactggctagccataagcagaagattgaaactggaccccttcctgacaccatatacaaaaatcaactcaagagggattaaggacttaaatataaaacctcaaactataaaacccctggaggataatgcaggaaataccattctgaacatagggcccagcaaagatttcatgacgaagatgccaaaggcaattgcaacaaaaattaaaatgaacaaatgagacctaaggaaactaaagagattctgcacagcaaaagaaactatcaacggagtaaacaaccgacagaatgggagaaaaattttcaaactatgaattcaacaaaagtctaatatccataatctatcaggagcttaaacaaattaacaagaaaaaaatgaacaacctaataaaaaagtgggcaaatgacatgaatagacacttttcaaaaggagacatgcatatggccaacaagcatatgaaaaaatgctcaacatcactaatcattagagaaacgcaaatcaaaagaacaatgagacaccatctcacaccagtcagaagggctgttaataaaaagtcaaaaaacaacagatgctggcaaggttgcagagaaaagggaacacttatacactgttggtgggagtgtgaattagttctgccattgtggaaagcagtttggtgatttcttaaaggacttaaaacagaattaccattcaactcagcaatctcattactgggtatataccaaaaggaatataaatcattctaccataaagacacatgaacacgtatgttcgctgcagcataacagccaaggtgtggaatcaacccaaatgcccatcaatggtggactggataaaaaaaatgtggtgcatatacactctggaatactacaaaaccataaaaagaatgagatcatgtcctttgcagtaacatggatgacactggaggccaatgagtgaataacaaaaagtggtatatatgcaccatggaatactacttggccataaaaagaatgaaataatgtcttttgcagcaacttggatagagctggaggctattattctaagtgaagtaggtcaggaatggaaaaccaaatactgtatattcttacttataaacaggagctaaggtatggatacgcaaaggcatagtgagtggtatcatgaactatagagactcaaaagcagggcaatatgtacagggtagtgtacatattgggtacaatgtacactacccaggtgacaggagtgctaaaatctcagacttcaccactatgcaattcatccatgtaaccaaaaaccatgtgtacctcaaaagctattgaaactttttttaatttttagaaagtattttttaaaaagaacgagaatctagagactcctccttcccaaaccttcacaacttcttagcaatacttttaaatttagatgtaataagagttaaacatgaaataaatgattaatagaatgactaaatgcttccactgattatgtggaagtaaaaaaaattataatttttttaagaagctgagagaggacaccgtgtggttgtctgggggaagggcatttacaacaaagggaatagcccatgcaaggaccctaaggttggaagccgcctagagggttcaagaaggcaaagagaccaggttagttggagcacagtaccatagggaaaaggggtaggagacgtggtcgggagaatattgggaagccagatcacatagggcattttagaccatcatgaggactttagcttttacttggactgtgacgggaagacattgggagtttctaaacagaagagtgatgtaacctgagttatgtttcaacaggatcattctgcctgctatgttgagaatgacttaagggagtgttttaattaacaaataaacctaaacatttcagtggtttaattcactttagcagtccgacgtgagcattctgggtttgaggatggtcttccacatagttattcaggaaaccaagttcttttgattttgtggttttaccacccactagggtctaaagattttatcctatagggtttctcaccctcagcactattgacattttgagctggataattctttgtttgggggagctgtcctggacactgtaggatgtttggcagcatcctcaccattgcccactaaatgccagtaacacatccccccacccccgactcatgaaaatgaaaagtgtctccaggcattgccaaatgtgccctggcaggggtggggcaaaatcactctcagttttgagccacagaggtagaggaagaagaaacaagaaacacctgcttctaaaccaccttgacccagacggttctctttttccttattactggttatcttattttcttattacttataaataagataatggtcatcttttttacatgacttatcttatttctgctgatatcccaattgtgaaaacaattcatatggtcccacctgaatagacaaaaacttgggaaatattcccgtctggacagccacttcccagcaacaactccctacgacagaagagggagttccaatcttagtggccagtttgctacaggagcctaaaggagaagcaattagctattgcaatggtccagatgagagatggtggtttctcaacccgggaggatagcagtatggtagtgagaagtgactgtgctctgaatgtgttctgatggtagagttgaccaaatttgctgatggattagaggtagggcatgagataaggagtggagtcaacaatggcttaaaagttttgagcctgacccaatgaaggaatggagttgccatttactgaggctagggaaacagcaggaagagcaggttgaggggagtatttgtcaggagctcgctttggggcatgcacatttgtttgagataaaagtgttgaatatctgagtggagatgttgagtaggcagtaagataagagtcttaactgggttagaaatataaatctggaaggcaacagaatagtaagtgtatttaaaggcatgagacaaggcgagaacatcaaggtagtgagtggagacgcaaaagagaagttcaaggtatgaggagataaggaggaggcagcaaaggagacggtgaatgagctgccagcgaaaagagaaaaagcagcagagtgtgatgttttgcaactggtgcatccttcccaccccaaccttcctattgccgaacatgcatgcacacttagagatctggtcccctccactgagctcagaaagagagaaaaagccacccagagttccctcctcagaggtctaggtcccagccccataggtcctcctccaaattcagtgacatcagcattagccagcacccccctctgaggtctgagtcccagctgcctgggactcttttccaagcttaaagacagtagcacccaccatccacactgcatcctcagaggtcttgatccaggttcacaggactcctcttataagtttctaagttgtaattatcccctctgttcccttagccccgggatgggagctgcttcctgcagttgcctccatggtacctgcttttacactttcagttacccggttaacaactttatacctacttcacaattatctgttcaaataactgtcatgtttttgtttcctgaatagactctggctgatgcaagtgatggacaagatcattcagagaaagaagttcaaggaaaggagaagccagaatattggaagaatcatctgtgtggttataaccaagaattatggaaggagtagtgttagagagagtgatggtgagccagggctaactgggggtcagtgtctagcttgtttacctgtggattcccaagaaatgaaggagaatgatccagaagcctgtagatggctgctacaataagggtagtacagttgatgacagaagactcaaagctgatagcaagattcatagcccatgggacagggagtcagctctgtggctgtcctttgacgttagagtaaagaccagcatgagttctgtgaactggttggtgccttaaattgtgtctaattctcctaccctgatagggagtctgggtgagggctctgcctggtcagcaggtccaggaggttctgaggaagaatgccaatgtgctatccttatttctggcttcaagcagaaaatggcttgcgaattccagagatgtggaacaactgtcttcagtggctttgtgtctactcccaggctgtgcttgcatgggcaatccagggccattgatagggtagagaggagagaaaatagtaccatcttccttacatttccttagatttccccagccttcccccctgtgatgtggtgaggcatcacaggaatggctgggtctccttggctggcccagggacctcccacaccaggatgacaccttatttagaattatagcatcatgtaaatgacgagttaattggtgcagcacaccaacatggcacatgtatacatatgtaacaaacctgcacattgtgcacatgtaccctagaacttaaagtataataaaaataaaattaaatttaaaaaattatggcatcatggacatgcctggaataattaggacttggtccaggaagacctcctctgggcttcaacactgtgcttgtaccagagcaagcagaggtcaggtgggagctgccagaagtcccagagcctattgcattctccatctggagaatggatcctggtcccttcagtgacccaggaatggggagttactgcccacctgcatgccacccctggcaatggagaaggccgtcaaccccccatgcctctttgccttctgtaggctttctggccacacacaaaaaatattcctcaacatgttcaggccgctgagtgttccttgagtaaggaatgccaggactcaggaagaggagtcactattatttgtcacctaccaacctggagtttctacagacagctccacctgaagccacaactggggaggtctagaggaatccaggaagctttctgattggctggtccaagaaatcacaagctattctctcccctcagatccaaccctgacatctagctgccgacccgaaactccacacacatgcccacactgagcccattgtcttccttctcagctctctgcccatccactgctctgaaccctgcccagctcccgccctagaaaaaaaaaaacccgcacttcatctagttttccgcatctcaggaaatggctccataatccatccagttgctcaaaccagaatgttattcttgatctttccctccatctttgcatatattcgtcattgagtttctaactccaaaacatatcttgaatctgcttacttttctccaccctaactgccacccccttgtccaagccatcatcacctgtctgctgaccaactgcaaaagcctaattcagctcccaacctccactcttgctcctttgcagtccatttgccccacagctgccatggtgaactttgaaaatggaaatcaaatcatgtcacttctctgcttaaagcctcccagtggcttccccggacacttagattgaatctaaagtccttaccatggtgtattagtttcctgtggctgctataaaaactaccacaaactcagtggcttaaaacaacacagatttactatctcacattctggaggggagaagaagtctgaggggactcaactagtttctctgctctgagtcttacaaggctaaaatcaaggtgttggtgggctgggctcttatcaggaaactgtgggaagaatctgcttccaagctcattcaggttgttggcagagtacagttccttgctgttataagactaaggtccccattttcttgctggctgtcaggcaggaactactcttagctcacagagactgctctccggcccttgactatgatccctacaacttagagccagcaatggtatgtccagtcgctctcacactttgaatctctctgacttctactgcatcttttctgactccagccagaaaaagtccctgcttttaagggctcatttgacatgactgaactcacttggttaatccaggatgaatctccctatgttaaggcctgtgaccttaatcacctcagcaaagtcccttttgctatgcaacctaacatattcataggttccaggaattaaggtgtggtcatcttgtggggaagccattatttggctatctcctctatgacctcatctccctctctccttctcactctctccacccagctacactggttttcttgccatccctctaacacgtgaagtttgttcctgcctcagcacttttattactaccatttcccaaacctggaatgctctgtccacagatcatcacataactgtctccttcacaacatccaagtctctgttcaaacatcacttcctcaagagacaccatccttgaccatcctgttggcagtagctcagccatcctttcattctctccaggacggtattctgttctttaatctcatagcactcataacagtctttcatgcaagcatcttgtgaagttgcttcttagtggcctgtggccccctgcagaccacaggcttcctgatggcatagatcttgtctgacttgttcacccctagattcccagccactagtgtagtgcctaacacaaagaaggcaatcaaaccaggtgcctgtggtcctagctcctctgaaggctgaggcaggaagatggcttgagcccaggagtttgaagctgcagtgaactgagatcgtgccactacacttcaacctgggtgacagagcgagagcctgtctcaaaattaaagagagagagaggaaaagaaagtaaaaagaaggcaattaattatttgctgcattaacgaaagtgggagacctgggatagggtggacctgcccggatgatcttagagggcctaaagtaaaacagaaagttggagtggtcacttacttgtgattgtgttgcataggctgcaagacagataagagaggttgagcttagatggatgctgaggacaatgtacttgctggtccctcagtgagtcagtggcagagttgaagttgagcactgatcccttgcctcccagctgccttctctgtgcatggaagctggctgcttaaaaaaaaaaaaaagaaaagaaaaataacacctgcttcctctgggttatcctaaagcagcctcacgtttgacatgattgagtaaaccaggccttgcttctcatctacaagcccacgaagacattttctgttttctccaatccactctctgcagtgagtcctgggtttgaattctgtattagtcagggttctccagaggacaggactaatagaatagatgtatatatgaaagagaacttataaaggagtattgactcacatgatcacaaggtgaagtcccacaataggacatctgcacgctgacaagcaaggaagtcagtctgagtcccaaaacctcaaaagtagggaagctgacagtgcggccttcagtctgtggttgaaggtccaagagtccaaaagctgaagaacttggagtctgatgtttgagggcaggaagcatccagcataggaaaaagatggaagctgggagactaagccagtctagttcttccacgttcctctgtctgcttttatcctagccatgctggcagctgattggatggtgcctacccagattgagggtgggtctgcctctcccagcccactgactcaaatgttaatctcctttggcaacaccctcacagacacacccaggaacaatactttgcatccatcaatccagtgaaattgacactcaatattaaacatcacagccacttcctagctgtgtgtctcacttagagagaggtccaccctctctccatcctaggtcaatcccttccctgggtactggttcccaggatcttcagactttcagcacctcacgaatttcctctcgcctttctttctctccagtctttctacttacttcctcttatctgggaggcaatgttgtatgttggctaagagcccagactctggtgacacttgcttgggatcagaacttagtttgccacttattatctctgcaacctaggctaggttgctttatctctctgagcccgtttcctcagctgtaaacttgggttaataattgcatctacctacctcacagggtcggtgaggatcaaataagaaaatgcgtgaaatgtttttaaaataaagtcagccacataattcgttatggtcactggcctcatcacattagcacaagacaaccttgttgttcatatccttaccaaaaaaaaaaacgccttcccttaactctacgtgtccctccagctgcccaccttgtgtcagccccactttacagcaaaactcttccaaataatagcctagactccttctctccacattttttttttttttgagaaggagttttgctgttgttgcctgggctggagtgcaatggcgtgatctcagcccaccgcaacctccatctcccaggttcaagtgattctcctacctcagcctcctgagtagctgggattacaggcatgcgtgaccacgcctggctaattttgtatttttagtagagacggggtttctccatgttggtcaggctggtctcaaactcccaatctcaggtgatccgcccacctcggcctcccaaagtgctgggattacaggcgtgagctgctgcacccagcctccttctctccgcttctgttccacctcttctttccctaaatctctccagtcaggctgctaagctcattgctccaccaaaacaacttttttcaaaaccatcaacaacttccacctagccaaatctcagggactcatttcagttctcaccttccttactctcagcagcatttggcataacagatgctctcttctggaaatgctctcttttctcagcttacaggtccccacatagtcctgattggcctcctacctctctgactactcctttttactcttttttctgggctttcctttctccatgggtccctcatatgttagtgtttcttaggaagtgtattagaccattttgtgttgctatgcaggaatacctgagactgcataatttataaagaaaggaggtttatttggctcatgattctgcaggctgcacaagcatggcaccagcatctgctcagcttctggcaaggccccaggaaactttcactcattgcagaaggtgaagggaaaacaggcatgtcacatggcaagagagggggcaagagagaaaagggggaggtccctaactgcccttaacaaccagttctcatgtgaactcaaagtgactactcactaatctctacaaggaaggcaccaagccattcatgagggatccactcccattgacccagacacctctcaccacgccccacctccaacattggggatcacatttcaaaatgagatttggaggggacaaatatccaaaccacataaggaccccagccctctcctctgatattttctcctttggtgatgtaattaacaaattggtgcaaattgtgggcagagttcaagaagtggtgcttaacttcaggtctgagaagaatggtgaggcccagcaccattaaaaaggccatccttcctccactgctctgcagtttcatcttttacataagtcaaatgacatgtattcgatcagtctctggactctgttctgtttcattgttcaggaatattttttatatccttgtgacaataacacactatcttaattaatgtggctttataaatcctgatataaggcggtgtaactgcccccagttctgttattcttcaggacagtcttacctattctcaaccctttgcatttccatataaatttcataatcagcttgtcaatttacacacacacaacctactgttatttttattggaatcatattggatctgtagatcaattttgggagaattaacatctaaacaatattgactctttcaatctgtgaacatgatatatatctccatttctctaggtcttttaaaatttctatcagtaatgccctgtagcattcattatgaaggttgtatacatcgtttttatactaaattctacataattgatgcttttgttgcaattgtcaattttatcatgtaaattttttctatttgtttgttgctggtctatataaatgatgtcacttattaattctaagaatttattttcagatatttttatgtctgctccaaattctatatccaaattttactagagacactgctatggtacaggagtctttgctacctcacatatcccagtctgctctgtgcatattttaacatctgtgagaacttcctgtggaatggaacttgagcccttgagatctgcccctgggcttctcacatgagaagcctgagcttttaaccaaatacaatattaaaatatataaataaagcctttaataagtacacattacttgtcaaaaactgctctaaaggagcatcacccttagtcctttgcatttatgaattaatttaatttccttaacatgcttatgaggtagatactaatataatctcattgaatagatgggaaactgaagcacagggaaggcaaaaattttcccaaggccatagcgtattagccactaagtgtttcaccattgcactattcagttgcccccggtctataaaatcaaactcctcttcagtctggctctctcaacttgaggctttctctacctcctcctcctgaaccttggctctttgcaagtcatcagtccacacacagttgactagcacccctcacctcaggttgctttaagggtaaaggatgagggaagtcagggaaagcttcatgaagaaggtgagctggactttaaaagtcgagtaaaagttgggcatgtaaagtggggctgcgcacagtggctcacactgtaatcccagcaatttgggaagctgaggccgacagattgcttgagctcaggaattcgagaccagcccgtgcaacatggaaaaatcccatatggtggttaatattgggtgtcaatttgactggattgaaagatgcaaagtattgttcctgggtgtgtctgtgagggtgttgccaaaggagattgagtcagtggactgggagaggcagacctaccctcaatctgggtaggcaccatccaatcaactgccagtgtggctagaaaaagcaggcagaagaaggtggaagaagctgactggctgagtcttctggccttcatctttctcccgtgctggatgcttcctgcccttgaacatcggactccaagttcttcagcttttggactcttgggcttacagcagtggtttgccaggggctctcaggccttcggccacagactgaaggctgcactgtcagcttccctacttttaaggttttgggactcagactggcttccttgttcctcagcttgcagatggcctactgtgggacttcaccttgtgatagtgtgagccaatactccttaataaatttctccttcatgtatacatctatcctattagttctgtccctctagagaccctgactaatatgccccatctctacaaaaaaaaaaaaagtataaaaattagccaggcctggggtagtcccagcttctcaggaggctaatgtgggaggatcacctgagcctgggaggtagaggctacagtgagctgagaacgcaccactgcactgcagcttgggcaacagagggagaccctgtctcaaaaaaaaatgcagtgggaggcagcctcaaagacatggagaagaaacacagaggcttacatggtataggtttcagtctaggattagtcttggtgggaaacagagtgttcatatcagttatggttattaccagtattactttgcctttagtgctttcattaaaacaaccatatttattgccatcgatactaaagtcatttgaaaaatgtcccatctttgcattgttcagccactgcaaaggtgacatttcttcaactgtattataacaaccttcaactactaatggaaatagttgagtgcatttgggttgtagagctatggaaatataacttgctactgcctccctccatcccattgtgattgagtctggcctcacagctgcccgtcaattaaccacatcatagcagaaggccgggaagcatatcaacaagttctcagaaaagtcagcttttaatttatttgcttgggaccaaagatcttcaatagtgtgattggagttggggttggagtggttataggataggaaagatcaagaaccactgccttaaaaaggcagtcagatgacactaaaaggacaagcaacaaaagaaaagagaaattaactggatttcatcgcaactaaaacttttcgtgtatcaaaggacactgtcaagaaagtgaaaacaaagcacatagaatggaagaaaatattcataaataatatatctgaaaggatctagtatccagaatacataaagaaacattacaactcagccataaaaagacaaacaacccaattaaaaattgggcaaaagttctgaatagacagttctccaaagaagatatacaaatggccaataaatacatgaaaacatattccacactactagtcattagagaagtgcaaacgaaaaccgcaatgagatacctcttcacacacactatgatggctatatttttttaaaatttggaagataaatgttggtgaggatgtacagaaattggaactctcatacattactggtgagaatgcaaaattgtgtagctgttgtgaaaatgtttggccgttccttagaaagttgaacatagagtgttatcataagacttagcaatttcattcctagctatatacccaagagaaatgaaaaaaaatatgtctacacatatttttcatagaaaatttttctatgaatatttatagcagcattattcataagatccctcaagtggaaacaattcagatgtccaccaactgatgaatggataaacaaaatgcattatatccatacattggaatattattcagccataaaagggaatgatggtctgatacatgctacaacatagatgaacctttaaaacattatgctaagtaaaagaagcaagacacaaaaggccacctattgtatggtttgtataaaatgtccatttatataaaatgtccagagtcagcaaatccacagaaacaggaagaagactagtggttgtcagggctggagggataggaggaatgaagggtggctgatatttcaaaaataaactaatgggattgcatcagactgaaaatcttctgcacaacaaagaaagcaatcaacaaaatgaaaaggcaacttatggaataggagaaaatatttgcaagccatataactgataagggataaatatccaaaatacacaaggaactcatacaactgaagagcaaaaaagcaaataaactgatttaaaaatagtcaaaagacttgaatatacatttctcaaaagaagacatataaatggccaacgggtattaaaaaggtgctcaacatcattaattgtcaaggaaatgcaaatcaaagctgcatacttgggaggccgaggcaggaggatctcttgagtccaggagtttgaggctgcagtgagctatgattggacctctgcactttagcttgggtgacagaccaagaccccatctctaactaactacaaaacaaaacaaaataccgcaaacaagagagtgaaaatcagtatgttgtagagatattggtgcccctgtgttcactgcagcattattcacaatagccaagatatggaaacaacctaaatgtctatggatggatgaatggataaaggaagtctagtacatacgtacagtggaatattattcagcctttaaaaaaagaaggaaatcctgacatttgcaacaacatggatgaacctggagggcattttgttaagtaaaataagtcaggcagataaagacaagggggaagagagaaatagggaagtgatggtcaaatggtacaatgttttagttatgcaagataaataagttctgaaggtctactatactatgctgtaagagactagatcttatgaagtgttgttaacacacacccaaaaacaataataaagagggcaggaggaaacagtgggaggtgatggaaatatttatggccttgataatggtgatggtttcacaggcgtatacttatccccaaactccttgagatgtacacattaaatatgcacaacttttaatgcaatatacctcaataaagtggttaaaaaaaagaaaatgttccaaaattgatagtggtgatggttgcacaactgtgaatgtactttagaaaccactggattgtaccctttggaagagtgaattttgcggtgtgtgaattatttctcaataaaactgttattttttaaaatgcagtcagagctacagcgagatgatatttcagattcctgaacccattggaatgatttttttttcagattttcttccctggaatattgtcatcatagcagtaacctccctgagccctgctcatcctcctagccttcactacccaggcctgtgagtcaggctcctttctctgatgcttttgccaccactgtttgctaattttccaagaaccctgctttcacctgctaaaaggatcccactctgccctgcccttcatgatattagggtaattcctgctatctgcttgtctgctcccctcttggatcaccctaaccaatggcaaaggaaagcgcatagttactggttgtatgaatatttccagatatttactctattggtttgggggtttctcacacttcaatttattatcctcttatcagcagctccagctactgggccttcattatatattaattgccagtgccaattgtcattattttttatattaaaaatccatctataaacacacttcagcagctccaccacctcaccatcattgctcatttaatctccctcctcctctattagagcagcagggggctaaccagagcaggagacactggggctaatcagatcactagtttgtctgaacattaagctcaacaggaactcagtaggatgtactaggtcaggtaagggcagattcaatcttccaccagctctgaggaccaacagcggagggacctggaatcagagacaattaaaggatgaaccccagcttgaaggggctgatggtaaagactgggtgactgttaggtggggtggctataactgagggctctgtgaaggcatgatttgatgagaagaatttcctggcttatgcaacactactcatcatctgacctgttcactcaccatttctcagaactcctaatgcagggagcagtggtagaaaatgtgttggccagcaagttaggagaccagggacttgtctgaactctattcctaagtgtgattcttggaaaactccataacctctcagggtatcacattcttcaactgggggcaataatccctaccttgctgacacctcagagttttgataagggccaaatgaaaaaaaaaaaaaaacttcagtgagtatgtattacttgttaagcactactttaagggagtattgttctttgcactttgcatgcattaactcctttaatttcctcagtagtcctataaggtaggtactatcatggtctcattgcactgatggggacattgaggcacagaggaggcaaacaattctctcaagctcacttgtgtatgtggctgtttcacatacacatgaacagcacagtggtgttcagccactgcactgttcaaccacccctagtctataaaatcaaactctagtctggctttcttaactggagtctttctctaccttctcattctgagccctggctttcacccgcgtatcttgggagcccctcacctaagagtaggagaagggtaagcattctcctcattctatagtgctttgctcaggccactgttctgccacctgcatgtaaaaccccctaatttttagccactcagtctatctagttggttccaccactctatttccctcctggttgccatcatctaatgacctcctagtcatggcgcctcagtcactggagatttagtttactgtcttcctcctactccaaagctggactatccttttgggtgactttggtgtccaagaggaacctagccataactgtaccagtcatagttcagtcaggaaagcagagccactgtggggattctgggaaatccgactttgcaaaagggtgggaagagctgggaagtgaaggtccagaagagagcattgaaagatcagatcaagagttactaatgactccccctaaagcactggtgtggtggacaagtcagggcttgcaggaaaacatggaaagttaagcacgtttagctgtttaagtcaatgacaaagaggagttgtgggacagtctatgagaaactgctgcctctatgtggctatcacttctgtggacccacaaccaagggcctagtaatgagcctaaggccactgttgaggagacctgaatttggaagagaggaaagcaaagaaacactggagccctcttcatacccctgcatctgcctgtcaccatatatggccatgaagactttcaaggagtagtgggccctgcttcatgtgccagccatctcatttcagtaaacttccctccccactcctaatctaccccttccatagtcatgacccaaatgtactgatcctctgaaattcctcatgtagtcatcacattttctgaccacagccccttacctttacctatctcacctcttaagttgctctcattaaggtcaccaatagtctctttgtcattaattcattcaacaaacatttgtttaactcccactctgtgccaggcactgtattggatgctggaatacaatggtaaggaaagacagatcagaaccccttctcagctgggcacagtggcacacacctatagtcccagcactttgggaggccaaggtgggaagatcgcttgaagccaggagtttgagaccagcctaggcaacatagggagaccttgtctctacaaaaaatttaaaagttagccgggtttggtgatacacgcttgtagttccagctacttgagagactgagtgggaggcttgcttgaggccagaagctcagggctacagtgagctatgatcatgccactgcactccagcctggtgacagagacagaccctgtctctgaagaaaaataaaaagaacctgttataatagacttctagtctgatgggaaagatagatatcaattatattatcccatgaataaatggagaattgcaactgagaaaagtgctccgaaggagagataagtacatggtgctattaaggagtaggatgggagaatctgtctgaatcagggaggtcaggaaaggctttccttagaaagttatgattgcactgaacatcaagaatgaggagaagggcggggcaccgtgactcacgcctgttatcccagcactttgggaggccgaggcaggttgattacctgaagtcaggagttcgagactagcctggccaaaatggtgaaacctcgtctctactaataatacaaaaattagctgtatgtggtggcacatgcctgtaatcccagctactcgggaggctgaggcaggagaatcgcttgaacccgggaagtgaaggttgcagtgagccgagattgcaccactgcactccagcctggggaaaaagagcgaaactccgtctcaaagaaaaaaaagggggggagaagttaactaggcaaagatgagaaggaaagcatttcaaacaaagggaacaatgtctgcaaaagccctatagcaagatcaaacaggattggatttattggtaaactagaagagggccaacacagaagtgcaaggtgagaagtatggctggaggtatacacaggagccagagctagatgccaacatgccagagctagatgccacacaaaagatttctgcctgattcctaagaactgtgggaagtcatagagaattttaagcagtaatttgaaatcatctgattcacattttcaaaagatcactttggctgtagcatggggagttcttggagcatgctacagtggaaagggagaggtcaattaggaggctactgttgttgaggccagagataatggtggctagacttggggtggttatagtggatattgagagaaattggtgaacttgaaatacactattttggaagtaaaattgtcagaattaggtgatgaattcgatatggtggagatggagacagcaagaatgacacttggatttctggctctgcaattggatgaatgtggtactattcattgatatagggaacactgaaggaatataaggagaaagagtagggaggaagatcatgagtttgattttgagcatgttaagtttgaagggcttttgtgatatccaagaggacatgtgttcatcaaaccataagtttatgggtctggagctcacaggagaggtctgggctggaggtataggcttgaaagttgtctatgtacagggatgactgaagccatagatggctgagactgaaaatttagagtaaacactaggaagaggagaaggtcttaggctgtaacttaagaaactctttgtttagaggttgactaaaagaagaccctgcaaaggagcagttggagcaatagaagacaaaccagaagagtgctggggactggaagtcaaggacagagcgggtttcaaaaagaaggcatgtgagcgaagaaagataaggatcaaaagtgaccaagggatttggtgacacagagagccttggaaccttaacagaaactgttttagtgacatgatagaaaaggaagtcagatcagagtgaggtgaggaatgtgtgggaagtaagaaaaaggagacagcaagtgcagacaagattgttggcagttttgattgggaaaaaatgactcatatacatacatattgatgaagcttatacagagaaaagcacagggaagatatgggcttggacatggagaccttaaccatgctgggatgagggagtgtggagtgaggcatcagatttcaaaaaagtcggcatagaagtgcactatgaaaaaagagttttggtttgagacaggatgtggtacccagttgattgtgtttgaaatgacacttttttttttattcatgtgtttatccaacaaatatttattgagtgcctactctgtgccaagctattctagaactaaggatacatcacagaacagaacaagcaaaagcctctcttcttacagagctggtgctctggttggagaagacaaacggtaagtaagtaaaagatagagtatgccagatgataagtgctacggagaaactggaaagggagcaggagcacagttttaaatcgagtgggtcaaagaaggactttctaagaaggtgacatttgagcaaagactggcatatgattagacaaagagtgttcgagccagagcgatcagcaaatgagatcacatgaggcaacagtgtgtccagcgtgttagaaggaaaccaaggaagctggtatggctagagtgtggtgaataagagggaagtgaagagagatctgtcacaaaggagacagtgagccatatcaggtaggccattgtaggaactttgattacgtcgttgaaggactttccataatctggcttatgctctgaaaggacccttctggttgctggggtaggaatagatgatggagtgagagatgcaagggcagaagcaaggagaccatttagcagattagtagagtaacccaggctaggactgatggtggctggtaccagggtggtggtcatggaggttgtgagaagtggtcagaatctggatatactgtgaaattattaaagtcaacaaactgtgttggattggtcaatggattgacaagtcaatgggttggctgtaataagtgaggaaagaggcaaagacttcaaggtctgggggcttgatcaaatggaagaacagagttgccatttactaaacatacagcagtagcatgtttgggaaaaataccaagaaagtgtttggcgtggatctgttctttgagacgctaccagacaacccagtgatggagtcaaagaggtagctgcagacagaagtctggagttcaggggagacttctggactgaagataggcatttgggacacagcagcattgggttgtatttaaactcaggagattaggtgggatcacatagaacatagtaagggaagagcacaaagactggttgctggagtctttcaaaattaagaggacaaggtttacacccagaagaattggaaacagggattcaaataggtatttgtataccaatgctcattgctgcattatacacagtagccaaaagatagaaacaactcaagtatatatcaacagatgaatgaataagaaaaatgtggatatacatacattattcagaaacaaaaggtcgagtaacgatccacactgcaacatggatacacatgaaaaacatgatgttaagtgaaataagccagtcacaaatgatcacatattattatatgatcccattcatatgaggtcttcagaattggcaaatcgatagacatagaaagtagaatgggaattaataagcacttttatcagaggggggaggagatggagagttattgcttaaagggtatagggtttcagtttaggatcatgaaaatgttctggagatgaacagtggtaatggttgcacaacactgtgattgtaattaatgtcactgaactatatatttaaaatggttacaatggcaaattttatgttttatatattttagcacaataaaaaatgtaaaaaaaaaaaaaagaggaaaagttacaggctgatgaggaggagccagcaaaggatactgaagagaaataatctgtaaagtaccaggaaaaaccaggagagaggagtgttctggaagccattgaagggtgtttcaaaggaaaaaggagtgagcaaccgtatcaagcgctgctcaaaactcaagtaagatgaagactgacatttcaccattgatgatcctcatcaaacaagttcattctaaaatgctgctcatctgcttgtcatttcaacggaaacatgagccatcatttgtttttaccctgagttagtaatctgagtcaattcaatgcttccaaagccttcttcaccctttcatatctacacacttttgcgagggatttggaattagccatagtggaaatctcacctctcccactgatgagccatgtgaccatataactttgggtaagccacttctctgagcctgtgagttcttctccatggtaagtaggcccctcttttgcacacttgctatgtggatggacctctctgagtggtcaaaaactgtgaagatatttgcatctcatgtgaatgctcaacaaaggggaaaagccccttataaaaccatcagatttcatgagaactcactaacacgagaacagcatgggggtaaccacccccatgattcatttacctccacctggtcctgcccctgacacgtggggattattacaattcaaggtgagatttgcatggggacacagagccaaaccatatcagtagccataggctcaatgacattaaccactagaatgtgaccaccttggtttgaggttttgttctgtcacttctgtctacgatcctgggcaagttacttgatttctgtaggccaaaattccctcatctataaaatgaacattgtaataaatacctagctcatggtatcatggggataactaataatagtacaaaatactttgtggtacttactctatgtcaagcccttcgcaggtatttgaatctgtgatcctcatgacaactctatgaagttgggacattctatcaatttggacaccgaagtgtggaataagtggttcacccaaggtcacccaaccagtcagtggcagtgatccaattcaaatacaggtagtctaaccgtagagccagaacagttagcccaactcttggcagcctccacctgagaaggtgtatgcagcatgctcagcaatatggctagtacatataaagtgcagtcaatgctgtttgttggtatagtaagggtcaaatgacactgactgagtctgacctgagggcagaacaagagactgaacacacatctcaggtgattctggagcactccaaggtggctgagaaaatttggtaggggaatggggtgagtgactacttgaggcatctgggttgatggggtcataggtccaaggtctctgatttgtggcacaaccctggaggagtcctgaggttaagctttctgacatcctggaagaataagatatggcatcagtaattagtttgttttagaagaaacatatatatttcttgcacattaatatttctgaactgaaattcagacccatactcatgagagttgagaacctctggtctagcaaatataaggcaaagatgtttttctcagctccctcttccccctctgagccaagagctctaggatgccaaatggtatggctgggccctgtggtccctgaggcagatccaggaccaagggagatagcctcaggtgggctcctccaggaggcaagagcagaatcccctttacttgggagctggacctggtaccttcatactcccaccatgagctgctctgctgccctggaaccactgatttatgccctttccctggcataaacccctgtgtcacttgcaccctctgttttcccaattgttttcccatttctaaatggctggcatcctctatcattacctgacccccagcttgaagcagacggcacaaagttaataagtgacagacaaaaagcaaagctactcagctcttattttgcatccacacttccccaaaagaaaggtcttcaaacaggaaagactagagtgattctcaatcagtagaggtacaatctactgggagcccagagaaggagatttccccaggcagtattcggaaaggggcatgtaggtttcatgaatgtcacagttactggtgttgcggaatgtgctgctggcatatagagggtaagggccagacatgttataagtcctccaaagaccttacaatggggaattctcccacccaaaatgccagtagcattttgttgagaaacactaaaacaagcttagtagaaaaggagttctactccagaagacagtggatggctagagtcctcaaggcccatgcagcagcaggaccgccagggtaggggtgcactgaaggtgttagaagacaggggttaaagtggtacatggtgggggctggtatgaattgggtggacaatgaggcaggaggggctgataaacccataagaggggcagagggcatagcatggacaaagagtgtgtggctctgtgaggaccaaaagactgatgtcaatgggaagttggagaatgaggtagcaagcagggtctggggcactagtgcctttgtaggtcatggaaaggagtttgcactagatctgagtggccatgaaacctgtgggggagggggagatcatgaggtcaaatttgaacacagtgagtgggtgttggttatgggacatccatgtggcaatgcccccatagcagtggagtatatggttctagagctcatgagaaagggcacagctagaggtaggggtatcagttcaggctgcacacagtggcaattcaagtcctgggtgtggacaagcttggtggtaaggcagtgtgggaagaaacaagggaaggagtccagaacagagacccacctgagggacagacaatcctacagtggagagagaggtcatgggaaagccaagagagggtggtgtcctggaagcctgcagaagacagctttcagaaattgaagaggagccataggccagagcggtcaaaaggtctcagaagacagaggttctttgagtctagaggcagggcccagaacccagcaatgtgcctggcacagaaaaggtgctccagatttgtggaatgaggggattaatgctccgacattccttatcaataaacagcacaggcagcagcacctcacatatttgtttgccacagggcacccctaaggtgtactgggcccctgtctatatagactatttgagttaccaaaatccgtgtgtcggtaccagcctgatgacctaatctgtctcgctcctatgaaagaaataccttgctggccagtgggagcaatcttttttcccaaaaacaccctcagcagaggccaagcatggcgccctgggatgattcccataggtgggagtcctggagcttctcaggatatctgactgcagggggtcaggtggaaaatagaggactgaagggagcccagagaagggaaaccagtaccaggtttcatgcaggtccgtagtctgggcttggggttaccttctggtcggtccagaggttccaggagctggtggggagcttcctgcttagaaggcactggaaagcatggggcccctgaaacacggggcttgctcaggctcaagggcaataatgaccgcccaatcaccctgtgaagtgagtgctattgctcccattgaacagtccacatagctgagactgggaaagggaaagtcaaactgtgactctatgtgtagaaagatccccaagagatggtcagaaaggggctgtggacgagaaaccgattgcagccaggagaggggagctgcgggagctgctgcgctctcttggagcctcgctcttcaccgcctccctatacccacctccctctcctgacgccctccaaccttcactccccacgcgccccgccccacgtgaaataaattccaagaccgcagcgcagcctgcagtgcttaggctgaccacagggtggcgggcgcccctgcgctgccgcccgccgcatttgtattctgagcgagccgccgcgtgcattattaaagtccggactctgcgtgctttcctgcgtcggcgtcctctgcggagctggctcagcgcagcgggagaaactggcttctggctaagccgcagtccatcgtgtcctggctggaaggccccagaagtcacctggcctctccttactgagggatggcacccagagggggacagggccttgctcaaggccacggcggtgcagccaggaccagaagcccggtctcctgaatactgaccctatacacaattctggatgtccctggaactgcacgatggacttaaggcttgcaaaggccctccaactagccctttccctggagtttgctgccactctcacccccaagcttccgaggtacgctgcttcctccccctccagaaagcctcctgcccaggtgtacctacagaccccctttcctgagctcctccatgggggcgggggtaagaggctgcaatcttctcacatttctgttcagagcacgccaggaaagaaagatgagagagccttctccattctccttctgtgtgtcctgaagtcttccagagactgccattaataacaggcagcttctgaaggcagctaggcagtcaaagagcagtaagccttccttcccacctgtcttccaggccaggaatccgacccctgctccccaaacagacccccacgtccttggacccagattcccccacagctgtgaaggatttttcatgtttagcctcactctgggagcagcagcctctccttagggtctgcctttataagaacctgaaggactagaccccgcgctcacgcttaatatacacggccagctccaggggagttggaagccaaattgaaccctcagtagcaaaaaaacattgtccacttacagctttaaaacctaccctgctaaattcctgccattatcttagaggcaggtttctcaattcagcagctcaacccagcgaatgggacaagtcatcatcatttctcacctgaattactacattagctagcttccacccttgcagctttacaatctattcccagtatagcagccagagtgattccattcaaacacacgtgaggacccacccctcctctgctcaaaagcttgcacgggctcccatctccaacagagtcaaagcctaagtccttgccatggcctgcgaggccctgtatgtcatctgatgctatcacctttctatccactcaccctactctcctccctttgctctctcccaatcagccacacaggcctctttgctgttccgcaaacctgcaggcgcatgcccgcttcggggctttgctctgcctatctcctctgctggaatgcacctccctttgatgtcagcttcatccttcaaggctgctcaaatgacattttctcactgaggccttccctgaccactccatttaatgctcgtaacatcccccgcatcctgctcttctttttttcatagcacctgctaacatatgtacatactatttccttatttatgatgctattaatattatatgtctctctctatctgctgtcccataaacctcagagggcagagatatttctttgcatcactggtgtatctcaagtgtctaaaccagcgtcaaatgagtgaatgaatgaccatgtgctgattgcatcagcagtccttggaagccctaaaaggttatatatacttataactccctacccttgtggctctgggagagtcagagctggtttagaggagcgtactctcaaggggctcacagacgggcctgtgaatgcttttaatcagaaattgtctccagtccttgccacaaacaaatgtgaattcatggtggtagagaggttaatgttgatcggagactctaaaaacaattcaggggtcaaaagcatgtcttttagccagaaggtgctcctggaaattcaccaccattgctaaaattgtttttcagtgaaaatggactctaaggttaaaaaaaaattaaaagcactttggtaacgcgactccaaattccttaaaatggcctaaactgaaaacatcatgatggtcccactagaaggacccacaaccagtctgacacatcatccaattatgtatgggaaactgtactctaacaggacagcttcatcgtgaataatgtccaaaggacaatttctagagcaattgatcaacccatatgcaatgcttcattgggagcagatgtgctccttgtttttctcattaccatgatttactgtcttctgagcttattaaagacagaggcttgagcccactttggtgtgtgtgtcctaggtgggcgatgggggatggatagaatgagggagggagacaagaagggagaaccaaccaaagagctggggagatttccactctgcgctggcagcatggattcacctgctggcacccacagctgccctcatcccagggggcacccagttggctgaacctgggctgacaggttgatccactttgttgagtgcttcccactggccccccttcaacacatccacacatacacacacacacacacacacacacacacacacacacgtgcacatgtgcatgcatccttactgctacatgactaccaccaaatgagcacagaaagagatgacatggctcttgtcagctccattcaggatatcaggaatctatttcatcaaatttaataagtttgtgtggttttgaattttcttgttccactgtcatatgaatctagattttcttccccagagcttgggctgtttcacacatacacaggcaaactcacagaaacacagacacgtacacaggcttaaatacacatgcacacagtcacacatatatacgtttacacacacttacacatatacaccaacacactcatacacacacacacacacacatcactcataaacactcacaccaaaaatccctcatgccaataatccctggactttggaaggccgaggtaggaggatcacttgaggctaggagttcaagaccagcctggtcaacatagcaaaaccctgactctaccaaagaaatatttttgtaattaaaaataaacaaaaacacacttattacaggatcaaatactgcaggacaaaaattacttttgtggcctaatgttttggattcttgtatttaaactttaaaaatcatgtagttattatttgaaatctacagatcttgtgtctacatgattagctaagagacaacatttaaggctgctgtagttataaacacttttctccaaaaacagcttgctcatgtctattccaaataaatgaaagaccaaatcattttggtccctgccactatattttctcttcttaacattgtttttgaagtaatagaaatttcttagtgtgttttataggaatttttgtgagatgaatgtaacttatatatctgctaaaaatcatcatgaggtgaaattgcaaaatcattatcattttatcctcctcatttgcttgtatttgaatatcatgtggtccttatgtctatgtcttgaagtagtagccctttacgaatataaatagtcaatattttctttacagaagaataaaatcaatttaaactgtataatgagtcaaaatgaccatggggaatagaagtatttagctgaattataaactgatattaaccacatctacagtaaaacccgcattttcactcaacacttattgagatactttcaaactggtctggttttaaagggggaaatatttaaataatttttaatgttgttaattttaattgaaattaaaccaggagttatcaccatcttcaagtttatcaaacccataaaacactgtcacagacccctaaataggaaatgttggctgaggctatgacactcatttcacaggcaaggacgtgtttgagacttggctctcctactactatcctatgggaccctggttagattgctgcttttctaggcctctgtttactcagaagtaaaatgggaaacattctcctaggtatcttacaatttttttaaataattttaacccaaatacgtcaacacaaagagccctgactgcacctagacaggcatggatctcaacaagtgctaagcagaattttaaaaattgaatcacaccaaggcacataatcaaaaggctgaaaatcagtaataaaggataaatctgaaaaacaggagaaaaaaatgacacattacatgaaaaggaacaaagaaaatttctactgatttcccatcagaaacaatgcaaatcagaagaaaatggaaacatgtctttagcttgctgaaattaaaaaatagtcaaccaagtcaacctaggccaggcacggtggctcacacctataatcccagcactttgggaggccgaggtgggtggatcacatgaggtcaggagttcgagagcagcctggccaacatggagaaaccccgtctctactaaaaatacaaaaattagcctggtgtggtggcacacgcctgtagtctcagccactcaggaggctgaggcaggagaatcacttgaacccgggaggtagaggttgcagtgagccgagatcacaccactgcactccagcctgggtgacagtgagactccatctcaaaaaaaaaaaaaagaagaagaaaagaaaagaaaaaatagtcaacctagaattctttatctaggacaaaatccttcaaaaaatgaagataaaataagggcattttcagatgaaagaaaaagctgagacaatctgtcaccgacagaacttcactataagaaatgttacaggtagccattcaagcagaaggaaaattacaccagatggaaacttagatctgcacaaaggaatggtaagcatcacgaacagtaaaatgtgggtaaatataaaagacattttgagagcagggtcttggggtctgtcattcactgatatatttccatccctggtacagaacctatttgttgaatgaaatacagtgatcgatcccacctcaaatgtcaggcatgtgagaagaaggcacccaccttatttccaaaacaaaaataattttatggtgttctctaattatagcgataatgtattatcatgataaatcttctgaaaatagagcaaattgttcagaaggaaacaaaaaatcacatgtaatctgattatccagaaaaaatcattgttaatattttagtatactcctgtccaggctcgctctctctctctctctctctctctctctctgtgtgtgtgtgtgtgtgtgtgtagatagatatgaatgtatatgtaaagagatatagatatatcaaaaattgaattcatagtgtacaagaaccctgcactgaatatccctgtaactaaatctttgcccacatcctaaattattctctgaggataaattactagaagcagaattgctgggtcaaggcaaatgaacagtcccacagcttaagctatgagctgacaattaccttccagaaagactaaaccattttcactctcccgtgctgaaagacagtgcccaccaatttgtactctcacgaatagtgtggtcattcgtacccgtttaaaaagacttgccatttgatacataacgcatacggggcttaaaacctaaatgacaggttgatgggtgcagcaaacctccatggcacatgtatacctatgtaacaaacctgcatgttctgcacatgtatcccagaacttaaaatatcataaataaataaataaataagacttgacatttgataggcattatagctttcatttacatttctccgttaattagtgagaatgaactacttttatgcctgtgggccatttagagttcatcattctgatgctcattcttattctggggctcaagtgagccagacccttgccctccaccagccctgggtctgcatcctagttgcctcctgtactcactgactttgggaaagggattaactttgcagaggcaccattatattgactgtcagtagaggataccgctgccctcataggattggcatgatgattaataaaacagcatgtgcgccgggtgcggtggctcacgcctgtaatcccagcactttggaaggccgaagcgggcggatcacgaggtcaggagattgagaccatcctggctaacactgtcaaaccccgtctctactaaaaatacaaaaaattagccgggcgtggtggtgagcccctgtagtcccagctactcgggaggctgaggcgggagaatggtgtgaacccggaggcggagcttgcagtgagctgagatcgcgccactgcactccagcctgggcgacagagcgagactccacctcaaaataaaaataaaaataaaaataaaaaaataaaacaacatgtgtgaggaacttatcccagcatctgatgctccgtcccaatacaagtacaagaagaaaaattaagttggggctatacactcataggataaaggtcttcatgttctgtccgagtttaatgagaatgtctctagggtttcacaatcagctatgatctgggcttttcatttgaaattgattttttaaaatcaggaagttcatcaaagtcctctactaggaatggttgctagtttatcaagcatctctttggtgtccattaaaattatgtgctcagtcacctttgaactactggccaatgtgattaattaaaacagtgaattttctaatgttgaatcacccttgttttggggtattccttcattcataaaacatttattatgcatctgctgtgtgccaggcactgttccaggctctggggatacaacagcaaaaaagacaaaccaagtctctgctctcatggagctcacacgttaatggtggagagaggcaataaacagaaataaacatagaatgtccatacaaaagacaagcatacatttggcatgtttgaggaatggccagatgacttttgtgactgggaagcctttggagagttttaagtgagggagtgacaagctgattatgtgtgaaaaaaaatcactctggctgttgtgtaggaaataggttggggaagggcacaagtggaagtagggataccatttaggaatctgttgcactcatctctgtgagagctgatgggggaacttggcttggaccacagaactagcagtggaggtagcttatggacatacaatcatatgtcacttaacaacctggatacattctgagaaatgcattgttaggcaattttgtcattgtacagacttcatggagtgcacttacccacacgtagatgggatacacgcctatcctaccacacatctcgtctgtatggtatagcctatttctctgaggccacacacctgtacagcatgtggctatactgtatactgtagacaactgtaacacaaggttaattatttgtgtatctaaacatagctaaacatagaaagggcacagtaaaaatgccatattataatctatgggaccacagtcatatatgtggtcccttggtgaccaaaaacatcgtcattatatagcacatgactacatatggatatattttgaaagtaaaagcccacaagatgcattgacagatgggctatgaggcatgagagaaacagaggagtcacagatagtagaatggagttgtcatagactgaaatgaggattgcaggaagagcaggttttgaaaggaagatcaggaatttggtttggaatgtgttaaatttgggatgcccgttagctatccagaaggagatgttaagtgggcatttggatagctgcatatggaataatccttattaattgtgtttcatcattcttttgatattgtgctgaattctatttgctagcattttatttagcattttttattcttttctttttggctatcattctcaggctttcaaatccaaattatgctaaatactctgatctaaatagtccaagtcaaaccccaagaatcttccatttttatcttattgcattttttgcttttattattttcaattgacatgtaataattgtgcatacttatggggtacagtgtgatatctcagtatatttatacaatgtataatgagccaatcggggtaattaacatatccatcaccccaaacacttaccatttctttgttttcggaacattcaaaatccattcttctagctatttgaaaatatccaatgaactgttgttaattatagtcaccctggcttggcgcggtggctcacgcctgtaatcccagcactttgggaggccgaggcgggcaaatcacctgaggtcgggagttcgagaccagcctgaccaacatggagaaactccgtctctactaaaaatacaaaaaattagccgggtgtgatggcgcatgcctgtaatcccagctactcgggaggctgaggcaggagaatcgcttgaacctgggaggcagaggttgcagtgagccaagatcatgccattgcactccagcctggacaagagtgaaactccgtctcactcctctgagagctcctctgcctggccgcccaactgtctggaaagtaaggagcgcctctgcccagcctcggcaccttctgggaagtgaggagcccttctgtccgattgcccactgtctgggaagtgaggagcgccactgcccggccgctgcaccatctgggatgtgaggagcccctctgcccgccgcaccatctgggaagtgaggagtgcctctgcccagctgctgccccgtctgggaagtgaggagcacccctgcctggctgctgtgcaaccctccaagtgtgaagtgacagccttgtgtgtgatttttctgccctccccaagtttgcattttcgacattaaagttcactttttaattaaaaaaaaatagtcaccctatagtgccattaaacactaaaacttcaggaatcttcattttaggagcactcaatagtcctggtgcggtggctcacccttgtaatcccagcactttgggaggctgagtcacaatgatcacttgagcccgggattttgagatcagcctgggtaacatagcaagaccttgtctctacaaaataaaaagaaaacataaaaaaaattatctgggcatggtggcacatccctgtagtcccagctacttggaaggctgaggtgggaggtttgccagagcctgggaggcggaggttgcagtgagctgtgatcatgtcactgcactccagcatggccgacagagcaagatcccgcctcaaacaaacaaacaaaaaaaaaaaaaagagaaagaaagaaagaaaagaaaagaaaaaagaaaaagaaaagcaatccatgagattctgacgcaggtagtccaaggacgattatttggaaaacactatgctttaatgcttttgatttcttttaatattattcatccatggaactccctatttatcattgtgtcagctttgatcatttatgttttcctatgaaaccatgcatgatatcccagagtttctaaatttagcatagaatttacaaaatattttatatatatatacacatatatatacacacatatatatacacatatatatacacacatatatatacacatatatacatatatacacatatatacatatatacatatatacacatatatacacatatatacatatatacatatatacactgtatatacatatatacacatatatatacatatatacacatatatacacatatatacacatatacacatatacacatatatacatatatacacatatacatatatacacatatatacatatatacacatatacatatacacatatatacatatatacacatatacatatatacatatatacatatatacacatatacatatatacatatatacatatatacacatatatacatatatacatatatacatatatatacatatatacatatatatacatatatatatacacacatatatatatatgtatttgttgttttttgagatggagtcttgctctgtcacccaggccggagtgcagtggtgcgatctaggctcactgcaagctctgcctcccgggttcaatcgattctcctgcctcagcctcccgagtagctgggattacaggcgcccgccaccacgcctggctaatttttgtatttttagtagagacgaggcttcaccatgttggccaggctggtcttggtatcctgacctggtgatccgcctgcctcgacctcccaaagtgttgagattacaggtgtgagccactgcacccagcctgcataattttttttaaacatctgtatctggactagagatatcatttggcattgagttatgtgtacttgtatgattcttttttcccaatattatttacccaagtttagccaattttatcttttcaaagacccagctcctcaatttatttttcttttttcatatatatcttaatttttcttgtcttttttttactttttattttaccataagaactaccctgttaactgaaatttatttttcaattgtcttctacttcagtgatttattattttgtctttaataattgcttctctttatcttcttcggggttttcattgttattgatattattgtttctctctaacttcttgaatccaatgcacaatcttttgtttttattatttcttttttattcatgacccaactggtctcaataattttctctggtttagagggacacaatctaaaaagtgtttcagaacagacaagaaacccaactctacttaatttttcccccactgaagatcactgtggagtggaacagaaatcatggtagctaatagtgttttttttttcttgttaaagccaactcttaataaaaaaaaaatttaaggaaggtggttctttgtcatctaagcttgggctggagtgggagagccaatcaaacacaacacaagctgtcacaccaaaaacaaagaaacaaacaacagacagtcaccaaatatatagggagaatcagaagcaaaaaacgaaaacaaacaaaaaacccagaaaatcaatctgagaaatgagttcaaaccagtgaaacagagtcaatctagcaaacaggaaagaactttctaaaatctaattggggaattagatttgagagatatgagatctgaggaggatttgagagaatatgcagatattctcctgcagtccactgtgaaaaataaaacaatattagaaaacaagaaactccttagaaatatccaacaggattgacccaaaaaaagtacaaatgagatactgactagcaaattggatggtgctgagactaaatttattaattaaaaggagtgatacagagagctgagcaaaatgacaaggaaattagaattgggagaaaagagttaaagatttgagtctccatgttgaaagagcccactgagtgctgagcgggaaaaacaaaatataacctcacatgttaactatcttggggaaattagtgaatcccaacgatgaagagaaagtcctacttgcttccaaaagaaaataaaaattatccacagggaaagataatcagatcagagtcagacttttcatttatagtattaaatgccagaaaacaatgaagcaatgtttgtatatttctaaggggaaattattgcatgctaaattctatatccactcaaaccagttttgtgaatgaaaggtgtagccattttcagatgttaaagaacccaaaaagtacctgagctgggtatctatggtttactgtccatacattccctcccagatccacccttcacccttctgtaacctgctgaccacctcaaaaggctgacttgcatgaacttcatcagtgttgctcccttgacctctatttcccaattgggtttagccaattagataccccagcagcgaattggaggaaggacagagaatcaggtcacggtatttattcccctgactccgttcttgcaaggtcacccctgagctgacttgtcccttggctgaatgaaagtcactacccctctcaacacaagtgactttataaactctgtatacaactgggtcctgggacacactctctctactaatcccttcaggcctaggagtggtaacaagtcagctgttactaagtcccaggtttttgcactttttaaattatcctctttctctcttgtcccatatgtttcctattgagacctgtctagtacaatcattggtatcagaaatagccccaggaaacaaattctcctaatgggattctgggtttagctttaacatgttttggggcagtacagggaatagtcttcttccaagatgatacagtccatggtaatccatggcattcagtaatatcatgattactcacatgatcaccatcccaaaactgggatgaagtacaagtggagggcaatgtgataggagataaagtgactatggcactcggttgacatagtaacaacagtgattgtaaagattgcagtagcacttagatccatattaaggctctagaaatcataggggaaaaaagactttaaaactatgaacatgcagttgagaacacaactagattgggaatgatggtatgtgggggaaaaaagaacacatgtagagcagcagaaggcttccacggcatcttagagcatttcctacctcctcaagcaagggcagatgtgactgtaggccaagctcaacgtctcattgcaatggttgcagaattgcagcaccaattaaatgttcagcccttgagtctcttaggttaagataagggcaccaataggaagagctgggactctgaaaaatggaatggaccttgtgcatatcctacaccccaaggagtcggaaaaggagtagatgctccataatctgcagttcacaatatcagcatacattcgtgtcactggagtaatcccatttgatcatattagtctttgatctcgcagtttgcatgtgcgggtggctaagacattgccttattggccacttcatatcagactcaacatgaacgcctcctggcgttttacatctaccgcactgtattcggttatgcagtcctttcattccaaaacctccatcacacctcaccagctctcatatccagaagcacggtgtttattgttaaatattttattttctctattaaatatacttatttagtatagtacagcccatagagcaggtgcattgcatgtatgttcatttttcaaaacaatatcttttgattcattgcctttctcctccgattgataggcaaagagactattctatggtgctttatttaaaatgaacattttaaaggacattgagaagccacattagaagtatagatattttgtaagaggtgagggtacccaaacaaaaatgattccataataaatatttatcaaaatcattttttttggggtgggagacagagtctcgttctgttgcccaggctgtagtgcagtggcaagatctcggctcaccgcaacctccacctcctgggttcaagcaattctcgggtctcagcctcccaagtagctgggattacaggtttgcaccaccatgcccagataatttttgtattttttagaagagacggggtttcgccatgttggccaggctggtctcgaacacctgacctcaggtgatctgcccaccttggcctcccaaagtgctgggattacaggcgtgagctactgcacctggcctgtcaaagtcatttttattgtggtaaaatatacgtaacctgaaattcatgcctttaaccatttttaaatgtttaattcagtggcatagtacattcaaattgttgtgcaatcatcaccacaattcatctccacagctttttcatcatcccaaactgaaaactctgtattcattaaacaataactttccatctctccctcctcttagtccctgccaaccatcattctactttgtacctctgtgaatttaactattctaggtgcctcatataggtgtaatcgcataatatttgccctattgtatttggcatatttcatttatcacaatgttgtcaaggttcatccacatcgtagtatgtgtcaaatttccattcctttttaaggctgaaaaatattccattgtacataatatattacattttgttcattcatcaacagacactggggtttttctactatttggttattgtgaataaggatacttagaacattgctgtacaaataaaaagaagaaaaatggaaaggagacttttgagaggtcacggagaggcaacccctctcttctgtcccagcattaaagcctttcaagatcacatatcgggcagtaaactcacaaactgaggtctctcctaaccacctctcactgcctccaggcccataacaagagttgaattccaatatagcccagagggagaggtacaattcctgttcagggaggatatagctcatattccaaaagagttacaagaccccagcaaagactaaattcattgccatgaatgtattcatctagtttgcaatgtttaatatgttggctcaagttcctaggactagtgttaagagtttacaagattgactaatcaaactcttgacttacctaatggcctgtacataatgaggttgaaatcttggaacttcctgagttattatacaatgctccagctgatgggatgctggatggatctattatgtgtatcctagggggtcagaacactactgattatggaaagtgattttagagaacacacagttacttataatatctaatactaaataaataaataagaacacacgagacttagacagtctgaagggtttcaaagaaggaagggagggacaccctcagaacttgcatggatcagagggaaaaacaagagggggaaattcaggatcctgcaaagtaaaagaaaattaaaaaatcaaaaagttggccaggcatggtggctcacacctgtaatcccagcactttgggaggccgaagcaggtggatcacctgagttcaggagtatgagaccagcatggccaacatagtgaagccctgtctcttcttaaaaaatacaaaaattagttgggcgtagtggtgcacacctgtaaccctagctactctggaggctgaggcaggagaatcgcttgagcccgggaggcagaggttgcagtgagctgagatcgtgccattgcactcccgcctgggcaacaagagcgaaactccatctcaacaacaacaacatcaacaacaacaacaaaaagtgacaaatcaggaccaaacattcagtttgacataatgctataactactaaataaactgaggcagtggttttattatttttttttattatactttaagttttagggtacatgtgcacaatgtgcaggtttgttacatatgtatacatgtgccacgttggtgtgctgcacccattaactcgtcatttaacattaggtatatctcctaatgctatccctcccccctccccccaccccacaacagacaccggtgtgtgatgttccccttcctgtgtccatgtgttctcattgttcaattcccacctatgagtgagaacatgcgatgtttggttttctgtccttgtgatagtttgctgagaatgatggtttccagcttcatccatgtccctacaaaggacgtgaactcattttttatggctgcatagtattccatggtgtatatgtgccacattttcttaatccagtctatcattgttggacatttgggttggttccaagtctttgctattgtgaatagtgccacaataaacacacgtgtgcatgtgtctttatagcagcatgatttataatcctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctgtccagcacctgttgtttcctgactttttaatgatcgccattctaactagtgtgagatggtatttcattgtggttttgatttgcatttctctgatgggcagtgatgatgagcattttttcatgtgtctgttggctgcataaatgtcttcttttgagaagtgcctgttcatatccttcgcccacttgttgatggggttgtttttttcttgtaaatttgtttaagttcgttgtagattctggatattagccctttgtcagatgagtagattgcaaaaattttctcccattctgtaggttgagaggcagtgggttttaaaatcctcctatgaagaaaacagtagacccagatgattttacaggaacattgtaccagcctaacaagaaacaaattattctacttttattcaaactgttgcaagacacagaaaaagagaaaatattctccaaaaaactcttatgaagctagtataaccttgttgccataatcatacaatgacataagaataaaaatgttaagcctattttatgacaaaaaaaattaaacaaaatactacaaaaatgaagtctagcagtttataaggaagacaatataccttaactaatttaagtttcaggaatatagggaggttttaatattagaaaatctacctaaattgttattcaacatattaataggtcaaaaaagaaaaatcttatgatcatcttaatagatacagaaaaagtattgatataattcaacacccattcatattttttaaaagctgtaataggccagccacggtggttcatgcctgtagtcccagcactttgcgaggccaaggcgagcagataacctgaggtcgggagttcgactccagcctgaccaacatggcgaaaccggtctctactaaaaatacaaaattagccaggcatggtggtgggcacctgtaatcccagttacttgggaggctgaggcaggagaatcgcttgaacccaagaggcggaggttacagtgagctgagatcacgccactgtactccagcatgggcaacaagagcgagactccgtctcaaaaataaataaataaataaataaataaaagccgtaataaactacaaacaaaaggaaactttcttaatgtaataaaggcacttacaaaaatgtctaaagcaaatatcgttccaaatatgggaaagttagaagcatctcctttaaatcagaagcaagacagtaatgccgaacttaccacatctattcaacgttgtatttgattaagttcctagccaggaaaacaagactttttaaaaaagaactataatggaaaggataggaaaagaataacaaaactgtcattatttgcagatgatataattgcctacatagaaaaccccagagtacagaaaattgtgaggggaaaaaaagagtttagcaaagtgacagaatataaaattatgacatagaaaacaattacattttcacacgtaagcaagaaacaattagaaaatgttttcttaaattaaaaaaacaccatttataatagaaataaaaccataaaatactgaggaataactctaacaagagatacacacaatttatatgcagaaatttatgaaactttattttgaaagacattatgaaaatctaaataacttaatacatagcccatgttcatggctagaaatacacaatattataacgatttcaattcttccaaaattgatctacagatccaatgacaatgctaatcgaaattctacattttccatggagcctgaaaactggctctaaaatgtatatgaaagagcaaatcgcacaaaaaaaaattatacatttctgaataaaaagaataagagctgggcacagtggttcacacttgcaattctaacactttgggaggccaaggtgggaggatcaatttagcccaggagtttatcagccagggcaacatggcaagaccttgttgctacaaaaaatacaaaaaattagccaggcatggtggcatgtgcctatggtcccagctactagggatgctgatgtgggaaagaagtcaaggctgcagtgaccagtgataatgccactgcactccagcctgggtgacagaacaagaccctgtctaaaaaaaaaaaaaaaaaaggataagatgggaagacattctctataaggtatcgagtctcactatagccaaatacttaggagtaaatataaccaaggaagtgaaagatctttatactgaaaactataaaatatagatgaaaggtattaaagatgacacaaataaacagaaaggtatcttgtattcatggactggcagaattaatattgttaaaatatccatagtgtccaaagtaatttatagattcaccgcaatccctctcaaaattccaatgccactgtccacagaaatagaaaaaactattttgaaattaatatggaacaacaacaacaaaaacttgaatagccaaggcagtcttaagcaaaaagaacaaagctgaaggcattacacaacctgactttaaaatatactacaggccaggtgtggtggctcacgcctgtaatcccagcactttgggaggctgaggcaggtggatcacttgaggtcaggagttcgagaacagcctgaccaacatgtagaaaccccatctctactaaaaacacaaaattagctggtcgtggtggcgcatgcctgtattcccagctactggggaggctgagacaggagactcacttgaaccccggaggcagaggttgcagtgagctgagattgcgccattgcactccagcctgggcaacaagaacaaaactctgtctcaaataaataaataaataatatatatatgtatactacaaagatatagtagtcaaaacagcatggtactggcataaaaacagacacgtagaccaattgaatcgtatagagagcccagaaataaacccatacatctacaattaattgctttatgcaaatgtgccaagaacgcacattgggggaaggacagtctcttcaataaatggggttggggaagctggatatccacatgcagaagaatgaaaatgaactcttatttcaccacttgtacaaaatcaactcaaaatggattaaaaacttaaacataagactttcaactataaaactactagaaaaaaacatagggtgaggctccatgacatcaatctgggcagaaatgtattagatgtgaacctaaaaacaaaagtaactaaagcaaaaatagacaaatgggattgcatcaaactaaaaagcttctacacagcaaatgaaacaatttaaatagaatgaagaaacaacccacagattgggacaaaatatttgcaaatcacacatcaaggggctaatatccaaaatatacaaggaactcaaactactcaataacaagaaataacccaatctaaaaatgggtaaagggcttgaatagaaattactcaaaaaaagaaaaaccacacaaaatagccaacagatattttgaaacaatgctcaacatctctaatcatcaaagaaatgtagattaaaactacagtgaaatatcccctcacacctgttagattggctgtgatcaaaaagacaaaaataacaaatgttggcaagggtgtagagaaaagagaaccctcatacactgtcaatgagaatgtaaattagcacagccattttggaaaacagcatggagtttccacaaaaaaaaaaaactaaaaatagaacgaccgtatgatccagcagtcccattactgggaatttatccaaaagaaatgaaatcggtatgctgaagggatgtctgcactctcatgttcgttgcagcattattcacaatagccaagatatagaatcaacctatgcccatcaatgaatgaaagcataaagaaaatgtggcatatatacacaatggaatactattcagccttaagaaaaaaaaagagggaaaagtgtggatggggaaatgggagctgttggtcaatgggtacaaagttacagttaagaaaaatatgctctggtgttctattgtgcagcaaggtaactataatgaatgataatatagtgtatatttcaaaatagccaaaagaggattttaaatgttctgactacatgatatgataaatatttgaagtaatggatatgctagttactctgacttgatcatttcacaatgtatacatgtatcaaattatcactgtgtaccctttaaatataattattactcatcagttaaaaataaaaaactcgaatggaattagtgcatggacaaatagatgtaaataatccaatggaacagaaaaaaagagaccagtaactgatttagacacaaagtttatgggtatttgccatatgagagaggatgcatgatagagcagtaggagaaaaagaattattcaattactggagctgaaaacaaaaagattatccacaagaaaagattaaatttgagcactaccttacattgtacacaattaacttcatatggatttaaaatttgaataccaaagctgggtgcagctcgcaactttaatcccagctacttggaaggctgaggtgggatgatcacttgagtctaggagtttgagaccggcctgggaaacaaaatgacgacaacccatctgtaaaaaaataaaaatacataaaataagaaaaaaaaatttgaggggtcgggctcagtggctcaagactgtaatcccagcactttgggaggccgaggtgggtggatcacgaggtcaggagttcaaaaccagcctggtcaaaatggtgaaacctcgtctccattaaaaatagaaaaaaattagctgggtgtggtggccggtacctgtaatcctagctactcgggaggctgaggcaggagaattgcttgaacccgggaggcagagggtgcagtgagccgagatcacaccactgcactccagcctgggcgacagagtgagactctgtctcagaaaaagaaaaaagaaaaagaatttgaatatcaaaaatctttaaacttttagattgaactgcagatgaatatatttttctcttggagtgggaaagtatttgatatgcatcaagataccactcagcaggagcagaaacatggtggcctagaaggagctggaactatggaagatatatggccactgccagagatgctattagaagcagagagaaggggagaaaatatcctggtttttccctcctcttgctctttgatatcatgccagttcatcccattggccaaacctaactggcaggccatgagcatctaaactaaaggatgccagcccctagtgattcagagtaaagcagaaggaggacagagagtgaatctgagagcaaacaggcaaatgatcagcacagatttcttaacttagttacgaaagtgctgactataaaagaaaagtttacaacataaaaaagcagaattttattcatcaaaaatcaacttaaagaaaatgaaaagataggccaggcatggtggctcacacctgtaatcccagcattttgggaggccaggtgagtggaccacttgaggtcaggagtttgagaccagcctggttaacatggtgaaaccctgtctctactaaaaatacaaaattagcggggcacggtggcatgcacctgtaatcccagctactcgggaggttgaggcataggaatcacttgaacccaggcgggggtggttgcagtgagccaagattgcaccactgcactacagcctgggcaacaagagcgaaactctatctcaaaaaaaagaagagagagaaagaaaaagaaaatgaaaagacaagccacaaaataggagaagatatttggcaatgcatatgattgacaaaggattagtatataaaaaactacaaatcaataataagaagaaaacaaacaactcaacaggaaaataggcagaagacacgaacagacagtttatagaagagctagtgcatattgccaacacccatatgagcagatgctcaacctcattagcagtcagggaaatgaaaaattaaaactacagtgagatgccatttacacccattcaactggcaaaaaattaagaagtctgacaagtgttggagaggatgagtgacaacagaatctcatacttccctgatagaagtgaaaataagtactaccacttagccaaaacaaaacagtttggcataatattgtgaagttgaatgtttgtatgccctctaatgcagcaattgtatctctaggcacaataggagacatgtatgggaatgttcacagcagcactgtttgcaatggcagaaacaagaacaacctaagtcacaatcaaccagagaatggaaaaacaaattgcggtagatgttcagcagtgaaatgagtgtactacaatctcaacctataacgtgaaaaaaatctttgtaacatgttaagtgaaaaaaagcatgcccatgaagactgtatttatagtaagaccctctttctataaagttcaaaaagaagtaaaaattataacctattgcacagcaatatatatacttatataataaaattatatacataagtaaatacatgtatacatatgttttttgaaacaacgtcttgctctgttgcccaggctggagtgcagtggtgtgatctcggctcactgcagcctcaacctcttgagctcaagcaatcttcccacttcagcctcccaagtagctgagactacaagcccacaccaccacacctggctaatttttttttttttcagagggagccttgctctgtcaccaggctggaatgcagtggcaggatctcggctcactgcacctctgcctcctgggttcaagtgattctcctgcctcagcctcccaagtagctgggattacaggcacatgccaccatgccctgctaatttttgtatttttagtaaagatggggtttcactatgttggccaggctggtctcaaactcctgacttcgtgatccgcccccctcggcctcccaaagtgctgggattaccagtgtgaaccactatgcccagcctatatctagagtttaaatcatttgatttataaatataaacatgaaagaaagtggttgtcttggaattgtgggagagagaaggatggagtataagcacaaattcagatgtcagatacaggtaatgccttagtcttcaagttggatataaggattataggtgttccttatagcaattgagtaattaaagtgaacaaataaagggcatgcaaaaaccagtggtgataacacattatatatcaagggttataactaatccaattctttgtaatagaggtcctaaggaaaataaaaagaattagttaataattctggataagcatagcagattgagcagatgagtttgttattgtttcctccagaaatctcactcaaattgactatgcagagatttttttaaatattataagctcacagtggcaaaagaataaaagaaaaaagccccaatggtactgtctatttttggaggttggaaagtggagagaggaatggtagctaacttagctagccagaggaagtcatcagaggtgagaaacaagttcatttccacagaacccagaaagccttcagaactggagatgccaggcatgaaggaaggcaaagtaaaagatggggctgaaaacaaaagagtcaattaaaagtcttttaaggaacagttccccatatctatcacagccagtcaggtattacacctccagtaaggagaaaggagatttattctctgccaaaagggggtacgccaggcactgtgcagagggattaagcaaatctacccactaattggtaaaactccccctcgtccagttcccagaactctgaatgctaggactaccagttgacaagcttcctctagtctgtctcaccagatacacccccacagattccagtgaaagcagaaaaaccatacctcatgcacatattaatagtctcagagagatatggcaagatattatggcaattaaagaagaagttatggaaaaagagaggaaaagaaagagttattggtaatttctaaaataatgatcactgaaatttatacttcaagaaaaagattgaaaataaagttgagaaaatctcccagaaacggaggcagagaaaatgaaaatgggaaagaaaatattttttaaactagagtatcaatctaagaagttcaaaattcaactaataggagttctaaggaacaaaaatacagactaaatagaggagataattttttaaacaatttaatgaaatttctcaaaactgaaagatatgagacttcatgaaggatatgagattgaaagaggctcaccaagtgcagtgcacatcaaaacaagtgagaaaagacccacaggaagatgctgcatcatgaaagttcagaaaactatgataatgagatcctagaggcttcaagaaaggaaaagaaaaagtaagtcaaaagattgataggatggtattagacttagcaactgcaacaatggagactagaagacaatagaagcatatcttaaaatttttgaaagaaagttggtcaggtgcaggggctcacgcttgtaatcccagcactttgggaggccaaggtaggaggatcatgaggtcaggagttcgagaccagcctggccaacacagtgaaaccccgtctctactaaaaatacaaaaattagctgggtgtggtagtgggcgcccgtaatcccaggtactcaggaggctgaggcaggagaatctctggaacccgggaggcaaagcttgcagtgagccaagattgcgccactgcactccagcctgggcaacagagctggactccatctaaaaaaaaaaaagaaagaaagaaaattatttccaacttagaattctatatccagcaatgtgtcgatcacatgcaaaggaataataaagcatatacaatgccctgatgcaaacatatacaatcccttgaaatgtgtaactctcatgcaccctttgtccagaagctactggaagatgtcctccaccaaaataaggaattaagatatatacaccatggaatactatgcagccataaaaaaggatgagttcatgtcctttgtagggacatggatgaagctggaaaccatcattctcagcaaactatcacaaggacagaaaaccaaacatcgcatgttctcactcataggtgggaattgaacaatgagaacacatggacacaaggtggggaacatcacacactggggcctgtcaggggctgggggactggggaagggatagcattaggagaaatatctaatgtaaatgacgagttgatgggtgcagcaaaccaacatggcacatgtatacctatgtaacaaacctgcacgttgtgcacatgtaccctagaacttaaagtataattaaataaataaataagaaaaagaaataaagttctcctttccaaagttaaaaaaaattaagacataaagaacataacatgggatctaggaaaataggaaagaaagagggagaaggaaatgcccaggatgacaagtgtaaactgaagcaggaaaatggagaagttgttaaaggaaggcatcctccaagagtaaaaaataagcaacctaacttaatgtgcttggctatattggaaaaaattttacatctctgcttagaaagtatagaagaaaaacttcatcacaggtgcagagaaagcaaaagcaaatgaattaaatgaagcaaatattgaccccaggaaaaaccaaaaagtttattgggcagtaagtcttcacttaatgtcattgacaggttcttggtaactgtgaccttaagtgaaatgacatataacaaaaccaattttcccacaggctaattgatataaacaagagttaagttcctatgccatatttctggtcacaaaaacatcaccaaacttctaaataaagactcaaaacacttctaatattaaacattgaaataaatgtgagctattcatgtatttaagaaaaattaattaaagcaaatggaataattatttactcaattattccagttcagggttgtggatggctggagcctatcctggcagcacaggacacaaggtaggaactgaccctggacaggacaccacccctttgcagggggcactcacacccgcacccacactcactcagactgggacaatttagaattgccaatgaccctaacaagcacatttggggatgttaaagataaccagagtacctggagaaaatccacgaagacatggggagaacatgccaaacccacacagattgtgacctcagccagggaccaattatttttctgtaacattacaacgaaacatcattgaatgaaaggatgttattcaatgacctgctgtaatatgaaagaaaaggtcattgtagttcactgtgtggctcacctgtgaatagtatctacatagtcataataatttaaacactgaatatttatttcaccaaagatcaggatagaactatatttgatgcaagaggaagagggattatggggcagtagcatcatgagagagataactcctcattttatatagtaggatcttaataaatgctatctaaaacagcacaggaatattcttttaaacatatggggttgatatctgcagaaacagctatggtttgaacattgttatctctggagagtgatgctcgggaacggggaggagagtgagacctgctgtttttcaatgtcagtccacttatattgaaagtgctatgtttttaattgcatgcatatatcactttgattaaaaatacatttttaaaaaatggagtctcgatgtggtggctcacacctgtaatctcaacactttgggaggacagagcaggaggattgcttgaggccaggagttcaagaccagcctgggcaacatagtgagactccattccttcaaaagaaatgaaaagtagccaggcatggtggtgcacacctgtagtcccagccgctggagaggctgaggcaggaggatctactttagcccaggaggttgaggctacaatgagacatgatggcagcactacactccagcctgggtggcagagtgagaaactgtccctaaaaaaatagaaatagctggatgtggtggctcacgcctataatcctagcactttgggaggccgaggcgggtggatcacttgaggtcaggagtccgagaccagcctggccaacatggggaaaccctgtctctactaaaaatacaaaaatcagccgggcatgatggcatgtgcctgtaatcccagctactcgggaggctgaggcaggagaattgcttgaacccagaaggcggaggttgcagtgagccaagatcgcacaattgctctccagcctgggggacaaaagtgaaactccgtctccaaaaaaataaaaaataaaaataaaataaaaataaaaaataaaaaatggaaagttttcctcacctttcccaccctccagaggtcaccactgtgagatgttgggtatctatatgcttccagatgttttactccatctatacacaataatcaactaactctagatggatcaaatgcttaaatatcaaaaacaaaacttaaaaacttttagtagaaaatagctttctgactttgggggtagggaagactttcttaaacaaaactcaaaatgcactaagaaaagattgataaatcaagaaattttgttcctcaaaagacactatactaaaaatgaaaagagaagttccagactgggaaaagatttttgccacacatacaaacaacaaaatatctaaggcaaagaaccagaaatcattaagaaatagataagcattgcaatgaaaataggcaaaggatgtgaacaggcatttcacagaaaaaaatacatatcatcaacatagatatttgaaaacaatatctactttattattgatcagggaaatgcaaatcaagaaaacattagatattattttatatccattcaaattgacaaaaattaggaaaactgataataccaagtgtaggagaagatgcagttcaacaagagctcttctgtatttctgataggaatacaaattggtacatcactttgaaaattagttcaacatcattttgtaaagcttaacatttcacatagcctttgacaagcaatcccacttctcaatgattgtgtgcatatgtacctttgtatcagaagacatatacaataatattcatagcaacaccattcataatagcaaaaatctggaactacgatctaaacgtccatagacaggaacaggaatatatatcatagctacatttactcaatggattattactatacagctatttttaaattagctatagccacacacaacaatatggatgaatcttagcaatatatattaagtgaaaaaagtgccaaaaaaattgtatatagtgtaacatttttattaagttaaaaacaactaaaactaaacaatataattttggggaacatgtacagataaaaccatatttttatttttttataaaataaaattatagagatgagctctcacgatgttacccaagctgatctcaaactcctggcctcaaacaatcttcccacctcagcctcccaaagtgctgggattacaggtttgagccaccacacctggcctataatttttttttaactaagggaatgctaaacacgagttttgaatggtcattatctctggtagaagatgctgtatatattttttgtacaaattgcacaaggtctaattcctataataaaccttttattctacatcacttatagtggttctgcttctctgatagaaccatgtctttacagccataaaccacaaatggtgattaatcaattttggcactgaagttccaaaatatgcacatgccgaacacacacacagacacacagacacacacacacatacacactttcctttcttgacaaaaatggaatcacattacacatgttgttttagcagcatgtttttaaactcaatgtattgtaaacaagacatcacaagaaaaaatcatagaccaatatctcatataaatgcagatgcaaaaattctcaacaaaatgctagcaaactgaatccagcaacatatataaagaattataggccgtgaccaagatgtatttatcccaggaatgcaaagtcaagttaacatctgaaaaatcacataatgttatagactgaatcaatagaataaaggatataaaccacacaatcatctcaataggtacagaaaaagcatttaacaaaatccaacaccctttcgtgataaaacactcagcaatttagaaatagaaggaaacatccttaccctaataaaaggtatctatgaaaaatccacagctgacaacacccttaatggtgaaagactgaaagctttcctcctaagacccacttgtattcaacattgtactggaagttctcgacagggcagttaagcaaaaaaagaaagaaagaaagaaagaaaaagaaagaaagaaagaaagaaagaaagaaagaaagaaagaaaggaagaaagaaagaaagaaagaaagaaacaaagaaagaaacaaagaaagaaagaaggaaagaaagggatccagatttgaaagtaagaagtgaaactatctccattggcagattacataataatgtataaagaaaatcctaaggagtccactataaaactatcagaattagtgaacaatttcaacaaggttgtaggatacctcatgaaagcttcctggcagttctgacaggtgggtgtggctatcttgcaaatcaggaacttgaaattcagagatgttatccaattttctctaatacatatatttaaaaaaaaaatcacagcttggatttagactcctctttctgactccacagcccatgctatttctaccacaccattaagcccaagtggtaggcttagtatctattgagtgagggggtccagctttcattgtctaaatatggatactgggagcagaatgaacaagaccacagaatctagtactgtaaagaatgacatctggccaggtgtggtgtttcacacctgtcatcccagcacattgggaatctgaggcaagaggattacttgaggtcaggaattcgagtccagcctgggcaacatactgagacccagtctctacaaaaaaaaaattaaaaatttagccaggcatggtggtgcacacctgtagtcccagctacttgggaggctgaggtgggaggatcacttgaacccgggaattggaggatgcagtgagccatgactgcactattgcataccagcctgggcaacagagcaagacactgtctcaaaaaaaccaccaccaacaacaaaaagaatagcatctctctatcaccacccacaggttggtttttatccgttgatgacaatgggagattttgttttataagtgggtgcggaaagagctgctgactgggaagagagaggaagcaggtggaagggcagcctcttaaactgggcctgagcccctgagccacagaggtgatggtagaagctggtggaagggttttcttaagagagttcatgagcccatgagcataagctgagctgttttggctccagggaataaagggtacctctgagtcagggagaaggccatagttcctacccatgtacagaatcccttttcattctggcactccaaggattagtggctttgggagcaccaggaaaaaggcactttttgcatgggcggtggcattttcatgatgggcatcactaggaacagtggcatcaaggccttcccaggggccctgtgggcagtagatggccccatatgggaaccagagccacaaagagaaagcataaatcagatgccactgggtggggctggtttgtggcacatgtgagggatattcccttgggggtcttccagaaatattgttggggggggacatttagaacaggggcagctggggactggagcctgtatcgttgataacagtgagacttcttcatttgtacacacaagctgctgaggctcacatacgtggaaaggaagttggttgcttatgttagttgctccccaggagacagtgatatcaggatatatgaagcctcctccatgattccaagaaattgctagagaatggttgaaggggctacgtttctgcaaaggcgtggggcataaactgtcatggaaatctcagcataagtgggaatgtggttccatcctgtctgcctagtgaagctaggaaatatttgggtttcagaaagtaagctagaaaactccaagtatgctgtgtgaccatgaagtaataatacaaatataatgttaactaatgcaaatctgatcctgccactctcctgcgtaaaacccttcagggactccccttagctaaattctatgtaaggtcctcttcatccaccactctctcccctctctggagtgagagtggtagtaccttctccagatcaaccatgctggactccttttagccccaggacactccatgctctcctttgcctccaggcctttgcacatgctgttctcacttcctagaatcctcaccccacacccatccctgttaactggctaattcgtatttctctttctcctctcagattaaatgtcattgcctgagaggtctctccttgaccctgactccaagactaacttaggtcccaaggacaaatgtttcctggtcttccctttcacagcacttgtcccatgggtaattcttcatcaatcacctcttttccctgctggagttttacaatctgtcccagtgaggataacatcagttctgatcaacactggatctctggtgccaagcacagtgctcagcacagagcagatgcgcaatacgcgtgtgtcaaatgaacagatgaatgaacatactcattggttaggtattcactctgtgccaggaactttgctaattactctacatgcatttatgtcctcattttatccctgattaaggtgaaaaccaatgaagttatataactgtcccaggtcacacagcagctaagtggcagagccaggactcaacacaggtccatctaactgcatagcccctcctcttaactagttaacaagcataccgcatcatatagggcaaagaaattcctatccctctgtaatcctgttcaattgggagatgctcttaagatgtggatttagacttagcagagaagaacaaggtcctaagtttgcacatgccagactagtttaccagaatcttataaatgaagtggtgctttctttgaccaattcccatggtttcctgtctctaaatctccaggaagctcaagaaaaaggatgcttagaagcaagaccaatcaggaggccatggcagtaatgagaggtgataatggcttggaccagggtagttgacagtagaggtacagagaagtcacaacagacaccagacaaaccaaagttgctgatggattggatgtggagtataagatagagagaggagtcatcaatgacttcaactttcttggcccaaacaactggaagaacatggagttgccattaactgaaatgaaaacaatggcaagtggaacatattggggaagatgggagttgcactgtatatcagttaagtttgaggttcttgttaaacatccaattggagataatcaagtaggccgctggatatggtgtctggaattcaggggacagatctgagctggagtctttcctaaatgtcaccttctgcacaatctcttccctgaccacctactgagaattctagctctgtatattccctgctttgtgtagcacttatcaccatccaatacactatctactgtacatgtttgttttgtttattgcttgtttccttcatcccactagagtgtcagctgcaggaaggcaggggtttttgtctggtacaatgcttgtgctatgattggatatttgtcctctccacatctcatgttaaaatgtgatccccagtgttggaagtggggcctagtgggaggtgtttggatcatggaggtgaatccctcatgcccagtttggtgccatcctcgtgataatgaatgtgttctcactcttagttcccacaagatctggttgttaaaaagagtctcgtaccttcctccatctcctcctcttcctcttcctcttcctccttttcctctttttcttcttcttcttctccttcttcttcttcctcctcctccttcttcttcttcctgtctctctttctttcttttgcccacacatgtgcagcttccttcctctcactttgtgatgcttgttccctttcccatcccaccatgagtggaaacttcctgaagcccttatgagaagcagatgctggtgccatgcttcttgtacagcccacagaactgtgagccaaataaacctctcttctttatcaattacccagcctcaggtatccctttatacgaatgcaaatggactaaggcagcctggcacttggtagtcccttaataaatatttgttgactgagtggatgaatggatttaataaaacaaaagctcaaagagaactcaacaacaaaaaaaattcagaagcatattgtgaataaattttctcaaaataaagcaagaattaaatcagcaaattgtaaaagcataccacatatcatgataaaaaatgaatatagaatcattaactggagatgtgtcctggttaaattatttaacttgaagtataaacaagagttcttcagatattcaaacagaaacagcaaattgtcaaaggaataaaaaccggacttttcttgtatttttccatagaaactatcagtgccagaagacagtggactagtgtccacaaagttctgagggaaagtatgaccccaaaatattacgcacacctagccaatttattattcaaggataattgctattcacaaacaggaaatactcaggggattaaccattcattgcttcttctaaaaaaaaaagtactacccaataagaaaaatcctgccaaccaagggatataccagaactcagaaatagctgtgagtcttgaatccattaaaatataacaacactaagactaactatagaaccttcactaaatgactctctggggaaatcacatcattgcaaaatataatgcattataaccattgccaaagtaaggcgaatataaccaatgaaaattgggatgtgggagaacaagaaaataaacgtcttcttccattgtgggtagtccattgacagtgtctacatagattttccaagaaaaaggaaaggaaagggaaaggtgggggaggggaggtaaaaagggggggaagagaaaaagaaaataatttctccaattgcataattttttaatgttgtttgtttgttcgtttgtttgttttgagacggagtctcgctctgtcgcccaggctggagtgcaatggcactatctcggctcaccgcaacctcagcctcccaggttcaagtgatgctcctgcctcagcttcctgagtagctgggattacaggcatgcaccaccacgcccagctattttttgtatttttagtagagatggggtttctccatgttggtcgagctggtctggaactcccaatcccagatgatccgcccgtctcggcctcccaaagtgctgggattacaggatttatgattttttttaaccccagggccttacaaaactagtagaccttatggggaagaaacatttacatcaagttcagtagtttctttattttctaactagttcctttttgtatatcttaaattcaagtaaagccaaatctgacactttttgttaaaaaattagcatgactgacatgatccccttgttataaaattattcattgatagcttgatgctttctacctttacatgtatataaagagacggttggtgtcttagtctgttttgtgctgctacagcagaatatctgagactgagtaatttataaaaaccataaatttatttaccacagttctggaagctgggaagcccaacatcaaggtgctggcatttggtgtctggtgagggccttcttgctatggcctcatgtggtagagggcagatgggcaaaaagggatgaactccctttgtctaagttctttcatagaggcacttaaccccattcatgacagccctcattgactcaatcacctcccaaaggccccacttcccaatactgctgcactgaggattgagtttcaacataaattttggaggggacacaaacattcaaaccatagcagctgggttgttgttcaccagatgttgactgtatttgtttcttttctgggtgacaaaatccttggtgatttatttgtttattcattgtaattcttaaattgcttcaatttttatagtatgcattatctgctttataaaaacaaagtcattattcttcttaaaaattaagaataaaaaaaaattctcccttgtgtgccagccaacacatggaaagctatttatcctgcattgtttataatagggaaaaatgaaaataatgtaaatgttcatgttggagaaatagttaaacaaaccttgtagtatttccaaaatgagcaacaatttaaaagaagaagtagaattatatgtatccaaatggaaagatttccaggaccgacaggtgaataaggaaggttgttgaatgatgtttatactaagatgccatttgtgtgtgtgcacataggttattgcagaagaaaaggtcaggagagaggtgtaccaattggataactgggactcctccaaaagcagctagggatagggccaagttggagggggtggctttatctgtaaaggatgaaaattttataagcaggatatctttgtgtactaatttcacaatttaaaatccatttatttttaagaaaatatcaaagctgaacactttgatagttggaggttcatagaaggtcagctttgatagtagaagaaacatgcttgattctagatccagcagcatgccaggaaaattcacagctgtccctcctcaagatgggatgtagtggagaaggttgcaccctagaggagggagacatttccagttaaagctgcaagacgatgaagaaagtattctgggaagagatcgagaaggtactaacatttgtttgcagtggagttctaaaaagcctttgagaagagcttgagggtgggagtagttgagaggaatcggagtgagactgcttatagcagtaaagggatggggatttgggttggggaaggggcttgtctttcctaaagtgtctgaggatgaccctgatgagagatctgactggaataactggctatagtccccctgctgcctaatagccccaaatttgcaatgcagtagcaaggaatctattctcggcaagggctgccaggaagtttgtggaaggctggcaagagctttgcttacctggtgagaggagtggcaacaagttggttgggttggtggcaaaggccttttatttgtgtattaatggacaatatatttctaaaaactaaaaatagcaaacacatatagcagtttctatgtgccagacactgttttgaaatgttttgcacatatactcagtccccacaacaactctaggaagtaggtcaagccccactatgcagtttggacactagggcacagtgatggcaaatgactgagtcacagcctcacagcttgtacatagaaaagcagggacataaactcaagcagcctggctctagtatctgagctcttaaccactagtaaaatgccatattttaacaattctgagatgcgtatttttttcatctgtgaaactagaatgcatctcacaattaatgatgtttcactgtttagttggtaacatttttactttcttaggggtatctaaaataatggtgcttcttaaattcagtgatacatggttttgaatggttgtattatccatcctgaaatcatgttgctctaggactgcccatgcattggtgcttggggaagatctttagcaccagtaagacccgagttggggctgagtggggtggcagttgcctgatcagggcctggtgatccacccccccaggtttcactagagcatatttcagcggcagattccacaggccacgcagtgaccaggtaggacaaaggacatggctacagtgaccagcaaggacctgagggtaacacagggactgcatgtgaatctggggccccttctctctgagaatataagagcatctccccatgcccagatgccattttggatgacagaagagtttgggaaagaaagcctaaaggactgagcattggccaggttcagtggcttattcctgtaatcccagcactttggaaggccaagacagaaggatcccttgagcctagaagtttgagaccagcctgggcaacagagtgggatgccatctctgcaaaaaatttaaaaattagctgggtgcagtggtgcatgcctgttgttcgagctactcaggaggttgaggtggaaggatcacttaagcctgagaggttgaggcttcagtgaaacctgattgtgccactgcattccagcctgggtgacagagtgagaccctatctcagaaaaaaaaaaaaaaaaaagactgaggacttagctaaactaaagtacctgaaagaaaacagcttatactgaaaaagggttggtttcctttgattaacaagttcatgtttttctctcctatatcaatgggaatggaagcttcaaaacaagatggaattatgggaagttaggaaggcagaacattttcacctatctgagtatagtgagtgtaaattttcaacctatattgattgtttattcatttgtatcttgcatcattacaaaaaggaggtaaggcaactgtattagtccattcttgcattgctatcaagaactacctgggactgggtaatttataaagaaaagaggtttaattggcttatggttccgcaggctgtacaggaagcatggctggggaggcctcaagaaacttaaaatcatggcagaaggtgaaggggaatcaggcatgttctccatggctggaacaggaggaagagacagaagagggaggtactacacacttttaaacaagcagatctcatgagaactcactatcacaggaacagcaagggggaaattcacctccatgatccaataatctcccaccaggctcctcctccaacactggggattacaattcaacatgagatttgagcaaagacacaaatccaaactatatcggcaccccaaatggtgttatggctaaaggacttagagagatggagactcagaaaaccaagcaagctcacagtgacactctgggtctctcgaggctccggtgactctcctgccagctcttcatccctttgcctgcttgtgcccctctccttctcacttgttgctagcaagttgcacttgctggggccaattccatgccccagcacattgttctgccaccccaagcacaatgctgacagtgctcagctctgccaggaagcctaccatatccctttatgcccatagaatctgaaccagatccctgggtgagaggtttcaggagctctatgccctcagccccaaacctagtaggctgagtggaagccccacccccagaggagttgcccaggaggaggttccagagcactgtcaagtaagatagagaattgaaaaatcagtgaccttttcaagaggagcttaggttctggatgggagatggcagcatgtttcaaacctgagagtgggcaatggcagaaacaggcagcagaatggggttgagttggtggtagggggcgactgttggggtgtaaggagttaaaaactaataccacccccccttctatgttcagaatcaattgacaaacttcacgaatttcctgaactccaggaatgtacctgcctcttttaagttcaagttggtacagactcaaatctctttgtcatttccccttaacatgtcacacagaacttccaaaacacttagagagccaaaacctgacagaaatgacaaggagcacttactctagggaaggtcttctggtttccaggaagagattcttttcagcttccccaagtaaggggaggagagactagatgaattagacatgtggggtttggccagcttatatcccttcctccttcttctgacaacaccttgtttctccattaaggaattagtcctctcaatctatgtggccctgaggggagtggtcagtcatatcccagactggctaatagggataatccattcccccagccagagtaattggtctaggggtgaacacatgactgaagctgggccaatgagagtctttctagagaagtgcatccttggagatctctctctgatagcaccacaatcaataacatcgacttaaagttaattaacaattaactttaataattgttaatcaactttaagttgttactagatgtctacaaaagaaataaattatttacagaataaagtagaaatgtgacaagaaaatagacccaacaaaagaaaggagaagcaaagccctggcaatattgagcccctaaagtcaactcaaccaatggacttctcagtttaatgagctgataaattttttttgtgcttaagttagtttgaattggatttccattatttatctaaattgttatgactactgcaatgcacataaatgagaaccaaagactctatggatcttcgctgggaccaccaatgtgggccagctgctctgcatccgttgcccgtagattttgtgacaaactgacttcttcaccctctactctccacttctcatctacttcatggcttttggactctcatggttcatgcttcctgatagcttcagcctcctcagaacttgccataggtacattacatctcatggctcctctgacctctcttgacctcagggactttcaacttctgctctcactgcttgctacctcatccttcagacgttttccagctcaagttccttagaggaactgatgagtcaggctcatgttttcatgctgggccacagcacagaacgctatataagcacactgcaagctcctttgagggcatccaaatatttcattttttgagcaatttaaaatggtattgtattttttattttcagttgccacatgttcattgctagtatattaaaatcaatttatttttgtattttgatcttgtatcctaagacagtgttgaattcacctcccaattgtaagagttgtggctttttttttttttttttgagacggagtctcgctctgtcgcccaggctggagtgcagcggcgcagtctcggctcactgcaagctccccctcccgggttcacgccattctcctgcctcagcctcctgagtagctgggactacaggcgcccgccaccacgcccggctaatttttcttgtatttttagtagagacggggtttcaccgcgttagccaggatggtctcgatctgctgacctcgtgatccaagagttgtggctttttttttttttttttttttttttttgagacggagtctcgctgttgcccaggctggagtgcagtggcgccatctcggctcactgcaggctccgccccccggggttcacgccattctcctgcctcagcctccggaatagctgggactaaaggcgcctgcctcctcgcccggctaattttttgtatttttagtagagacgaagtttcactgtgttagccaggatggtctccatctccttacctcgtgatccacctgcctcggcctcccaaagtgctgggattacaggcgtgagccaccgcgcccggccgagttgtggctttttaaattgattctctgagattgtcaacataaacaatcatgccatctgcaaataagagcagttattttatagggccaaaactgatcgagctgaaaagataagtagacaaaaccataacaatagttggaggcatcaatacctgtctgtcagtaattgataaatccaacaggtagaaaatcagcaggagtatagatgacctgaacagcactctcaatcaacttgatacaaccgatagttataaaatactctatccaacaaccacaaaatgcacattcttctcaagttcacatggtaaatttaccaagatagaccacattctgggctataaaactcaccttagaattttaaaagagtagaaatcatataagtatgttcatataccacagtggaattaaactggaaatcaaaaaaaagaaagctagctacaaaactgccaaatattttttagattaaacaacatacttataaataacacatgggtcaaagtctcagagaaatttttaaatattttgaactaaatgaaaacgtatcaaaatctgtgggatgcagtgaaagcagttcttagaggtaaatttatagcattaaaagcatttattagaaaaaaagagattttcttgggggggcgatcccaagatggccgaataagagcagctccagtccacagctcccagcctgagtgacgcagaagacgggtgatttctgcatttccaactgaggtaccaggttcatctcactgggacttgttggaaagtgggtgcagcccacggagtgtgagccaaagtagggtggggcattgcctcacccagtaagctcaaggggtcgggaaattccctttcctagccaagggaagctgggacagatggtacccggaaaatcgggacactcccaccctaatactgcacttttccaacggtcttagcaaacagcacatcaggagattatatcccacacctggctcagagggtcccacacccacggagcctcactcactgctagcacagcagtctgagatcgaactgtgagacagcagtgaggctgggggaggggcatctgccattgctgaggcttgagtaggtaaacaaagtggctgggaagctcgaactgggtggaacccaccacagctcaaggaggcctgcctgcctctgtagactccacctctgggagcagggcataactgaacaaaaggcagcagaaacttctacagacttaaacctccctgtctgacagatttgaagtgagtagtggttctccctgcacaaagtttgagatctgagaacagacggactgcctcctcaagtgggtccctgaccctcgagtagcccaactgggagacacctcccagtaggggctgactgacatctcatacagccaggtgcccccctgagacgaagcttccagaggaaggatcaggcagcaatatttgctgttctgcaatatttgctgttctgcagcctccactggtgatacccaggcaaacagggtctggagcaaactccagcagactgcagctgagggtcatgactgttagaaagaaaactaacaaacagaaaggaatagcatcaacatcaacaaaaaggacatccacaccaaaaccccatctgtaggtcaccataatcaaagaccaaaggtagataaaaccacaaagatggggagaaaccagagcagaaaagctgaaaattctaaaaatcagagtgcctcttctcctccaaaggatcgcagctcctcaccagcaacggaacaaagctggatggagaatgactttgacgagttgacagaagtaggcttcagaagatcagtaataacaaacttctccaagctaaaggaggatgttcgaacccattgcaaagaagctaaaaaccttgaaaaaagattggatgaatggctaactagaataatagcatagagaagaccttaaatgacctgatggagctgaaaaccatggcacaaaaactatgtgacgcatgcacaagcttcagtagctgattcgatcaagtggaagaaagggtatcagtgattgaagatcaaattaatgaaatgaagcgagaagagaagtttagagaaaaaagaataaaaagaaacgaacaaagcctccaagaaatatgggactatgtgagttttacttttatgttgcttttgcctgagatgaagtactctttttggccaggactgagtcatgcaatattacccctatggctgaagggagtggagatcattaaaccctgtgaaccacatggaatgggcagggatactatacaatgattatgatactactactactaatatctattgagtgcttagtaagttccaagcacttaatgtattaactcccttatttctcatggtaaccctataaagtaggcactagtgcagtggtcaccacttatctctggttttgctttcagcagtttcagttatccatggtcaaccacagtccgaaagtatggagatattttgaaagagagagggagagagaacattcacataacttttattgttataattgttctattttattattagttattatttttaatctcttgctgtgcctaatttataaattaaactttaccatcagtatgtatatataggaaaaaaaacatggtatatacagggttcagtacgatctgcagtttctggtatatccactggaggtcttagaacagatccttcatggataatgagaggctactgtactagcctcactttaaggatggagaaaccaaagcatgatgaggttaagtaatttgcccaaggtcagacgtccagtagatgatagattgaagagaggtgattccccaaaggagtgggtgttgagccaataacaaagcatatgtccactagttagttaaattgtgttcatgctaattcagcagtagctatgaagaagagactccccgattctgatgtctagcaaggtgaattctcagagctttgctatggaactgggagaatttattaagattggcctctagccagaagcaatatacccttcaagaccagccaaactcccttggttcctgagaaacttgtgctgaataatttgatttttcagatgtcctgaatgggaagggaaaaccctaaccaacaagatctagtattcccatagagagatgtatagcaatctcctccacagagagatggatctgctggcttacagtctaactgccagtcagttgagagtttagggagagtgagtcactgccccatctcactcccattcagaacctcaaacttcagggtgaactggggagagcaagattttggccctgcaaacctgaggggaaaaatccatggcttttgatgtactgtctcctctccctaataatggataatcttagtagtagtatcatgattattatacagcatccctgcccattctgtctggttcagagggttaatgatccccactcctcttgagccccagaagtggcactacatgactacggcttctcatcttcagaggcttaggcggcttactcatgcttgttgctgttatcattgccatcttctcctcttcctcctcctcctcctcttcctcctcctcttctctcccttgtcgagagaggaagagagaggagacatgcaccactctcatgaaggcagccagtgatagaggcaggctatcccagacaccaccagctaacacaaagcccgttcaccctcaggtttctgtgtgccaacctggcatagctgtccctggcacctatagggtgtggccttcaaatagctgtcagttgctgagggaagtaatccaggcccctgatgtgtcactcgtgcatgcttttctctttttccccaaaaatgtattaggcatgtggaccaccaattacatgccaggcccccttgacacaacttaatcctctggtcaagtgtttggaattatgatgacaaagggcgctgtcttcttggattctccaacattcttatcaggtccttgaaagtgccaatgcagttcccagacaccaaatgggcccttaggaagacagcattcttcattccttccaattaacagatggggacatagaagctcagtgagattaagtgactgattcaaggccacacagttaagtagaggaggagaaagtccttaggttttctgactgcaaagttagtgctcttggccctacaccaagctaacctccaatgaggggatttgcatctctctgagggatatcaagccatagtgattcatgctgaggggagagcatgagcctgcaagttgggaggcctggtgtatgagtttgctagggctgccataaaaaaataccataggctaagtggtttaaacaacaaacatttactttctcaccattctgagaaatagcactatttctctaactgctggtaatgctgattctcaagtgtcagcttgttctggtgtcagcttttgcaggaattgttcacagctgaaaagagtagcctagctccaggtcacatccccttcaagggacagctccatccagtgactggttgatgtgggaagaggaggggtataatggcccagcccctctccacagctctgaatgactctgaagagccattccagccccaaagttccccttggggttgaccaaatccttgttgtgacttcactgcagctcaactgctccttctgcccactgggcttcctgtccttcccttgtccaggcattgatcccgaaagcacacacaactccgcctcagtatctgtttcccagaaaacccaactaagaactgtaacaataatgatgataaggtgtgatcgcactgcaagaggaacatgtttatgctgcagtggaggagatcatcatgtgatctcattccctacagctctactttcactcacaccattgcaggcccacagatctttttactgttcctcatacacactgttctcctcagggcccttgcacatgccattcccctgcctaaaatacacatctcccagacagctacacagcacactccctcacctccttcaagtccaaaattacagcaccactttcaccatctggcactgctggccttctccatgcgtgacttttatccatagcatttaccgctttctaatgtactatagaccctacttctttatcttgtttatatggtcagtatcccccaactagaacgtcagctccatgagggatgggaattttgtgtgtttttgtccttattatctgcctatttacaaaacaccttcatcagtgcctgatattatatagtagatccacaataagtacttattgaatgaatggatagatggatgaatgaactgtataattaataaggaaacagggatgctcaaagacttcctagaggaggtgccacttaagctgaatgtgaaagcgaaatgtgaccactggagttattctgaagagcctccaggaatcaatgcacaggagtttggcttgtgaattttccattttccacttttgggtagtttaaggctataggctttttcatttaatttattttacagtcccataaaaatcaaagggaaacaaacatgttttttttcttttacaagcgtgagaactttgggaatgtggttggaggcagaggggcccagagcctgcttccttggtccatacgtgtacgtaaaaatcattcactgagcagttttacagtcaacagaaatttttgcttttatttattttttattttttgtggcagtcctttcaaagcaaacaagctcttggtaaaactgaagcatagagtcctaaccaagttgctcatatgtgaaaaagctttgggaaattcagggactgtatttgcaataaaacctttgcagtggccagggaaataggattgtatattctggttaatgcaagtgtctgccgaacagaattactgtgaattcccagaccttgatgagctcaatccagaaaactgaaatataccaagcacagagaacaccaatactccaccaaagagaacttcttcctttgatcactcagaaggtatttgcatattttgcaagcctcactgtcaccttgatgaccccgagtgtcagtgattgtgcgactttgagaaatgtaggtgtaactgacctctagttgggaatatgttcggcagcctttgtaatgaactcattaaatgaaagtcagtttcttaagaacttgtttcccatgtgccttctaatgcagtggttctcaaggggtcaggtggttggaggaagtgctcttagaaaggcggagagtgtctcagaattatctgggggcctttatcaaggtaaatacctccactcaccacagccagagattaagaccctcccacagtttatcacaaagcaggtacatttatatctgcattgccaatgatagtgctgctcagatacaagctctaggctccaatccttcccccaccacctactgagagtctaacacaggacaatgaccagtggggaagatcagcctgcctgccttctacatagtagtagaatgactttggacaatggacttaattgagcctcagttactttttctgaaagctagagctaataatcctagcactgactgcatacactacacttctatctggccaagagagactttcagtactttgtgtctctccacgaagtcatcacattcttatggacagccagatacatttccttttatatagtgccatctctagtcagcctcaaacatgtcacgcctgtgttggcaccatcttcatggccccagaacttgccatcaatggacaatgagtattaccagaagtagcaaaaaatactccaaaaggcctgcggcccttctaagattaggactgtctttggtatattccagtgtgtttggtatatttcttgagttccagtatatttggtatatttcttgagttccaccctgatctccaaataattctctgttttatgtatctgaccttccaggaatggccatcttgaactagaattcagtttcagttttccaacatgcttctcaccttcctaccttgtttttcagtgccaggaaataaacaaatccttagaaactaaactcaaacaaatacattcatttatttaatcattcatttgctcattcagcaaatatatgctaaaggcttactatgtgccaagagctgtgctaggctgtgagatacaatgatggataaagcaggcatagtttctgccctcatgaaatttatagtctaaagggagaacaaaaattaacaaagaaatacttattcaaaaactgtgccaagtgtcatgagggaaatgaatggggtaccctgacagaggatggagagaaggaggcatctactgagagagggtaataaggagccatctctcaaaggaagggacattttagccaaatgcaaatggatgagaagccaggcatgaggagagtaggggaaggatattccaggcagagggaagaatatgtgcaaaggccctgaggcaggaaagtgtgactggagtacgtgcaagtgaaggaaagtggcaggaaattaggctgggggtgggcagcagccagatcctataggaccttgtgggtcacgggaaggaggtttgcttttattctaagtacaaagagatactattgcatgattttaagcagaggagtgacatgagttgaagttacattttcaaaaggctcactctggctgctatatagagaatggattataaagggcaggattggagccaggacaccagaaataagctactgccatagtaagggtgacagatgatggtgacttgaactagggcagcagccatggggaaggagagaagtggaccaattcaagacatatattttagagggagtattggaatgactgtccaagagttagtgagcagtatcctgtcccagagctgcggtcagggatggcagggagtggagtccttggcttagtcaattttgtgctgctataacagaacacacaagactgggtaatttatgaagaacagaaatttatttctcatagttctggaggctgggaagactaagataaaggcaccagcatgtgatgagggccttcttgctgcattctcacatggcagaaggcagaaaagggcaagaggggatgattctccctcctcttgagccccaggagtggtactgcatgactttctctcctcacatacagaggtttagacagcttgctcaaatttgccattgtcatcgtcttactcctccccttcctcttcttcctccttctcctcttcttctttctcttcttttcctcttccttctcctcctcctctttctcctttctcttcttttcctcttccttctcctcctcctctttctcctttctctctcctttgctggggccggacatgcaccactctcatgaaggcagctggtgatagaggcaggctatcccagacaccactgcctagcacaaggcccattcaccctcagagttctctgtgccaatctggcatagctgtccctgacacttgtagagtgtggccctctcatagctgccagttgctcagggcagtaatccaggctcctgatgtgtcactcatgtgtgtgtgtctttctcttttcactacaaatgtattaggtatggtgaggatggcacctccctcagcctgggccctgagtcaggtgatagatgacttgcaatggatacatagaataaagtgagaagtaagccttattgagttagcactgagatttgagggttgcttgttactgcagcattacctagcccaatctgactgacacaccatcctcccaaattccagcttcagatctaggagccactacttctccataattgagcacctcttcacagagacctgccctccactagacttttgccccacagacctgtccttggggttaccctggagctactttcccccaaataatgactttgaccttctcaacaagttgtaccaggcccacgtgaaagcctagagcagagtcagcctgaaggctggggtcaggagcaagctgggcagtgaaatgaagaaataagatgattgttaatgggttggattgtgtccacccccattcatatgaaatcctgacccccagtacatcagaatgtgatgtgctgctttggaaatagggttgttgtaattagttaagatgatgtcattagagtggcctctaatccaacatgattgatatatccttataaacaatggaaattggggctgggtgcagtggctcatgcttgtaatcccagcactttgggaggtcaaggcaggaggatcacttgagctcaggagtctgagaccagcctgggcaccatggcaaaatcctatctctacaaaacatacaaaaattagccaggtgtggtggcacacacctgtaatcccagctactcaggaaacaggtggaagatctcttgagcccggaaggcagagttgcagtgagccaagattgtgcatctgcactccagactggacaatagtgtaagactgtctcaaaacaaaaaagaagaagaagaaggaaatttggacacagagacacacacagggagagcaccatgtgaagatgaaggcagaggattaaagattagatgatgattctacaaaccaaggaatgccaaagattgtcaacaaacccccagaagctaggggaggggcctgaaacagattctctctcacagctctcagaaagaaccccaaccctgcccacaccttggtcttggacttgcagcctccataactgtgaggaaattaatttctgctgtttaagccatttagttcgcagtgctttgttacagcagccttagaaaactaattcaatgagaaatagtagtgaaattcgcagcagtgttcataggcaaactttgtagcccttcatgcagttttcagagtgtttccaagttcccatggcagctggagatgtgggcagactaagtaggtccccagactaggcaaagattatcaagcataggctggaatcaggggaccttgagagtttgaacaaaagacatcccagctggaaccactatagaccaaagttacaagagccaccactggcttttggactttgagaacacctctagactttggcatgatcttgggatgaagccccattagtgactgaaatagaattttctgccatcctggtattgtgagttgaatataaattgatttaaagaattattttaatgagaccttcctggtagcccaaaatttgtggactgagatgcagaaattctacattagctgccatttattcagtgtatactcaggtcttccatggcccctaaacatggcctccaatgccaagcatggccaggcctctgccttccctgcagcctcatttcttactactatctttctcttccctaaacataccaggctagttcccatctcggggcctcttcacctgctgctgtatttacgtttaacactcgcattagtcatccactctctgcctccctctggttattcacagttcaattcattgtctactactatatttcccttccctaaacatatcaagttagttcccatctccgggcctcttcacctgctgctgcatttacgttgaacactcgaattagtcatccactctctgcctccctctgatcattccctctgatcattcagagttcaattcaaatgccacctttctagaaagggctctcttgacttcccactctaaaatagcgacttcctcctcattctatcacattattctgcctcatttccttagtatccattactcactttgacatcatctggtacatctgtttacttacttgtttattttcctcccacattacccactgcagggcaggaactccatctgtcatattgaccaccatgcaccagccctgaacagtgcctggcacatagtaggcttccaattaatagtgttgattgaataagttaacatcttctcattcattgccaaccctgagtacccagcacagtgcctggcacctacacactcaaataataactgttgaaagtggaaagaatgcctagagtggagccacatagaggaggaacagccagtgcctcctactagaactgaggggtgcagggtctctgccactccatccccacattagcccaccacattgatagacatatgcccctctaccaccatatcagcaggacagagcaactgctgacaaacaagtttccatttgtcatgtaccttggcacccctgagatgacacataggtttctaagactgttgtctgattcttgcacataggtccaggatagagtactacatagcaacagcaattttctggtgtcatttcaagagcttcagtgattgagtcatgttggggcaaggagaacacccacttcctcctcctcagagaggagaagttgccttatatgatagacaagtttgtaactttttaatttttttcactaatatgattcttaaattgacaaatcctaattgtatacatttatggggttcaaagtggtgttttgacatatgtatgcaatgtggaatgattaaatcaattgcacagcagggtggctatagcccataatagtgcattgtatgcttcaaaataactaagagtaaatttcaaatgtttcaccacaaacaataataagtaagtgaggtggtgggtacgtttgaaaggagaaactaggcattggtaggccagctccttcttccatttcccactttctctacactgcccttggccagacaggaagcctacaggtaagggaggaggtaaggagagtctatctgtgcctttcttctttgttttaggtctcaactgcttgcaggctccagtgaggaagagaaacgctgtgagttgagctccctgaaatccaaaaagtaaaaccagaaaggaagctgaaattgtaggtgggaaggaaggcagtgctggaaggttgagcagtgcccagcaggtatgttttactgaagggagccaggaaagcaccatggcaggtaggtggtgagggagagcattgaggacagaatcaagtgttcatactgagaaatgaaggatactggagccctcaacaaacatggagcatgttgcaggattctccttcacagaagccatcagcagccatagtctgaacagcatttgaggcacacaccaaggtgggcatatatatccgaggtatccaatggcttgggagagctaaatgccaggtggaagcggggatatcagggatctgcctcaagtcagtgtaggttgaagagctgtttgcctgggaattactactcaagaaaatgtgtctttctaatactgatctgcatatttataagtcaggtccagtctcatttcgatttggtgttgactggctgccggtgaagtaagtctgagggcactccatgcacaggtccactgcagggacctaggctgcaaactcatgctggccaatccaggagccacaagccccttgtgttcatagagcatttaaaactgggttagtcccaattgagatgtagaaaaaaaaaaacacactggatttcaaagactaaaaataattttatattatgtcttgaaatgattacatgttgcaaataatgagttaaataaaatatattgctaaaattaattccacccttttccagtttttgttttttgttttacttttaaatctagctagtaagaaatttaaaattacacatgtggctcgcattatatttctactggactgtgctggtctagacagtgctcgtagtgatcgtagcctatgatctgctctccccagcagagatgcttgggtcctgtattagtttgcctggagtgccataacaaaaatgccaaggaccaggcagcttaaacaacagaaatgtattgtctaacagttctggaggctacaaattcaagatcaaggtgttgggagattgagttccttctgagagctgagctgtgagggagaacctgttccagccctctcttctaccctctggcagccttaagtgttccttggcacagagttggcattcattctccctatgtctccacatcatctttcctctctgcttgtttgtccctctgtccatatgtccccataacattcttgggacctatttgtagccacaatggagctcacctagggagaaacggatggagtttgacagagatagttttactgagacaaagtataaacacaatgataccaatggattctcagtaggatactttttttcttttttctttctttttttttttttttttttttttaaatggagtctcgctctgtcacccagcctggagtgtagtggcgcaatctcagccgcagtctcggctcactgcaacctccgcctccctacttcaagcaattctcccactgcagcctcccaagtagtagctgagattacaggcatgtgttaccacacccggctaatttttatattttcagtagagatggggtttcaccatgttggccaggctggtcttaaactcctgacctcaggtaatccgcccacctcagcctcccaaagtgctgagattacaggcatgagccactgcgcccagccatcagtaggatacattttaacagcattattgtcctaggctgaagcttcgtaatgtgtagaaccaaagtctctttcagccagagggattgagtccctctgagctgggttcagctagctcagccagtgaaaaatcttaagtaaatagagacttgagtaaagactttttgcaaccagcctgtgtggagtggtgagcactaaatgctgccagtccgattatattcactgacatctgggacatgatcccaaaatttggtctaagctcatttccccgatggcattccctactgcagcactttccaaactttttttttagccataaagccctttctctaaacaaaatgttacatggtggcagaagatgaactcagagcctgtcccattggaattgagtgagggtagtttgaaggcctaaagcacctcacactgaacttcgggggctcctaggaacacaagcttaagactatcccactccttcccaactgtatttgctggcctgtctatcaaatctgcaggcctacctcttttttgtctttaaactaactaaacaaaaaaagtgtttcaaaatagtaacaaaataaaaatttaagtaattttttgatgtagaaaacttggtgagatagaaggtataagaatgaaatgaaaaatcatccataatcctggaatccagaaataaccactattacggccaggcgcggtggctcacgcctgtcatcccagcattttgggaggctgaggcgggcggatcacaaggtcaagaggtcgagaccatcctggccaacatggtgaaacctcatctctactaagaatacaaaaattagctgggtgtggtggtgcatgcctatagtctcagctacttgggaggctgaggcaggagaatcgctggaacccaggagatggaagttgcagtgagccaagatcacaccactgcactccagcctggctacagagcaagactaaagaaatagccactactaatatttttctgaacatcctcctagtctttttaccaaacaagtatagaaagaggtagagacacacagatacaggtactgataagacacagatacaggtgtagatataggaagagacacagacaagacacacagaaatgtagatacagatagagatgcaagcagaaacacagatacagatgcgtatacagataaagataagatgcagatacagagagagacgttaagtagagacacaaatacacaaacagagatagaagtctagtcacagtaatggatgcagacagatacaagtagagatgcatatacagataaatatagagaaacagatacagatacagagagaggcacagatacaaatagaaacacagatataggcacagaaagaggtacaagtagatacacagatacaaatgagatagaggtagagacagcaatacagatagagatagagatacgtgttgaaaacaaaaataataagagacacagatacagatacaggtgtaggtgcacagataaagatatatgtagagccatagtagagatacaagtgcagacagaggtacaggaagagtcacagatacagaaacaggtagagacaaatacacagatacagatagagacatagacacaggcagagaggcacagatagagatagaaacacagatgtagaaacaggtagagacacagatataaatatacacggatacaggcacagatagagatataggatgagacatagatacagatacaggaagaggcctaaatacagatagacacagatagaatatagacataagtacagccacagagatacagatagagacaaagatacaggaagagagagatacaggttgagacacaaatgcagaaacaggtacaggtagagacatggatacagataaaaatagaaatacaggtagagacaaagatacaaatacacatataggaacaaatcagatatagatacagatggtgacacagatacaggtacagaaagatatacatattaagacacagatacaggcatagatacagacgcaggtagagatacagatacagatagagacacaagtactgctatagatacagttagacaaacatacagatactggtaaaaacatgaatatagatagacacagacacagacataaacacaggtggagccaaagatagagatacagagacgcagacataggagcagagagatacaggtagagacactaatgcagacacagatacaggtagagacacagatagagacatagatacaagaagacatagagacaaatatacatacagggatagatcagattcgatacagatggagacatagatgcagatacagacagagatccatattgagacatagatacaggtagagacacaggtagagactgaggtagaagcacaggtggagatacaggtagaaatatacagacagtctacactatgaccataccatcctgaatgcacctgatcttctctgatctcagaagctgagcagggttggacctggctagtactcggatgggagaaatacacatgcagacacagatgaagacacagatacagaaacaggggtataagtagagacacaaataccaattcagatacaggtgaagacacagaccagatagagataaagatagagacacagacacagatataaatacaatagaggcacagatactgatacagatagagacagaggtaaagatagaaacagagacatagatacatatgcagggagagacacagtccagatacaaatggagacaggtacaacacagaaacagataaaattagatacactgatatagatacagatagaaatacagattcgggtacagaacttacatatagagatatacatacaagtagagacacagatacagatacagttagagacacagacacaaagagaaacacagatatagatataggtagagacacagatacagatataactggagacacaaatacaaatacacctacaggaagagatattgatagaggtagacagatacagataaacatacgtgtacacacaaagatccagaaagagatagagacagagataaaggtagcaatgcagattctgatatagagacacagataaaggtacagagagagatacagataaaggtagaaacactaatacaggaaattatatagacacagttcagaaaagatacaggtagagacagaagctgatacacatacaggcacagatacaaatatagagagaggcatagatgcaggcatagatagagacagaaacatagattcagaaacagatacagacaaatggaaagacacagatacaatacagataaaggtagagatacagatacaggtatagacagagatacaaatagagacacagatacagatgtagatagggacacagatacaacagacacagacacataaactgatacagacacagatacaaggacagatacaggtaaaaacatggatgcagatatagagacacaaatatatgtacagaaagaaatatggatagaggtgcagacacagatatagacacaggtacagaagagatacaggtagaggtacagatgcaagtcaagacacagatacagacgcagataactgtggagacacagatacaggtaaagatgcagatacaggtacagatagaaacacagatacaggcagagacagaaatggagaaagagagacatatacatacagaaagagacacaaatacagtagaaatgcagacgcatgtataggtagagacatagatacagataaagacacacatatgtgtacagatacaaatacaggtaaggacacagatacagatacatatacagacacagatacaggtgtagacacagatataggtacaaacagagatatagacacagatacaggaatagacacaggtagaaacacagataccgatagacacagagaaacaaatacaagtagaggcacaaatacaggattaagtaaagacacagatatatgtacaaacaaacataaggaagagacacagacagatgcataaagatacagatacagatagattagagacacatgcagataaaggtatagatacatatacagatagttattcaaggggagacaaaaatacagatacagatgcaggtacaggtaaaggcagagattcataatcagatagatacacatagacagacaccaaatgcaaataagacacagatacagatgtagatacagtagagacataaatataagtataattgcctcagaagtagtagcagaaaaaaagagaaaaaaattaaaaacaaatacaggtacaagtatataatcatatatagttaaagatacagacacggatatagatacaaataggctcacagatacaaatggaaacagatacagatataaacacaggtagagacatagacacagacttagatacaggaagagacacagatacagataaaggtagagacagatgcagccagagacacagatctatatctacagagagacacagatacaggtataggcagagaaacagagacacagatacactactgatagagacagatacacatatgggtgcaggtaactacaaggtagagacagatacagatacaaatatataaacaggtgcagatagagctagaggtagagacacagacagaaatctacagagagacacagaagcaggtacagatacagataccggtagagacacagaccagatacagagagagacacaaatatagatacatgcagaaacacagatacagatgcagatggagacaccaaccagatacatgtagagacagaaaaacacacacatacggagaaagagaacatctagagacacagatacagatagagacacagatgtagatgcatatagagacaccaatgcagatgtagacacagatacagatccagataaatacatagctacagatacagatgccagcagagacacagaccagatagagatacatatagagacacacatacacgtatagacagataaacagatacagaagacatcggtacagatatactttttcctcaatattgacttccgatccaaaactaggtttagtggcacatggaagataccaagtattaagaagaactctctggaaccattaaagagatcctggggactgcccagtttgtgggctgtaatgttaatggccaccaccctcatgacatcatagatgacatcaacagtggtgccatggaatgcccagccagttaagcacaaaggaaaatatttcaataaaggatcatttgacaaaaaaaaaaaaaaaagaattgacagtatcattaacagctttcaaagatggcttttagaatttattgttagcttctgctaaatcacttgcttctggtaatgaaaattgtaaaactaattggctttcccattttgctttggcagcctggaaattcagagccaacaacaatccttactcttaactgtagctctgatgttcttcatattcatacagttctttacctggtcttgattttccactgctgtttctattttctttaggcctgattctcttttcctcttttattaaattgtgttttattgtaagcagcctcaaatccattgtgaaatgaggccaggtgtcaatcaatggaataaaagcagctgtataccataggggtttcatcagacagaccaggattcaaaccccagctctgccacttcctagtatgttactttgggcattcatgttcccttggtaggcctcgtcaggcatcaataaaatggggataataataccacattcacagggttgtttgaataattcaataaaataccatatcatatatacatcaaaacaccaagccccattcctgaaatatagcatgcagtcaataaagatttatattcctttaaaggaggtatttcatttagaaaaagctggttgccatgagctgcatacttgagtggaagaaagaagattctcggggagagggcaaaggttgaggctgatttgtgattccaagaatattagacagggttctccgtagaaatggaatagaatatgtatacatacaaatacatatctatatgtgtgtgtatatatatatacatacatacatacagtcaggcatcacttagcaacagagatatgtgctgagaaatgcatcattaggtgattttgttgttgcaaaacatcctagggtgcacttaacacaaacctaaatgatatagcttgccacacgcctagggtgtatggtatagcccattgctcctaggctacagacctgtacagcatgtttctgtactgagtactgtaggcaactataacatagtggtgagtatttgtgtacctaaacatatctaaacatagaaaaggtatagttagaaaaacagtattataatcttaagggaccactattccatgtgcaatctatcattgaccaaaacatcattctgtggtgcatgactgtacatatacatacacataaatatatacatatatgtatatatatagtattgattatatttctataataaatctcattttatatatgtatatgtgtatgtatatataatgacatttattatacaaaattgactcacaggattatgaaggcagagaagttctaacatctgccatatgcctgctggagacccagaaagccagtggtataaattcccatccaagtccaaaggcctgagaaccaggaacaccaatgatgtaagtctcagtcccagggcaggaaaaaatcaatgtctcagctcaagcagtcaggcagagaggaaattcctcctccttctgcctttttgttctattcaggccctcaacagattggatgatgttcacccgcatctgcattacccagtccaccaattcaacttctaatctcttccacaaacacccgcacaaagacaacaagaaagaagcgatcacagctcactgcaggctcggactcctcaactcaagtgatcccctttcctcagcctcccaagtagcggggactacaggcacatgccaccatatctggctaatctttttttttaagacagagtttcgttcttgtcgcccaggctggagtgcagtggtattatcgtggctcactgcaacctctgcctcctgggttcaagcgattctcctgcctcagcctcccgagtagctggaactacaggcacacactaccatgcccagttaatttttgtatttttagtagagacggggtttcaccacgttggtcaggctggtcttgaactcttgacctcaggtgatccacccacctcagcctcccaaagtgctgggattacaggcatgagccactgagcccggccacacctggctaatttaaaaatatatatattgtcaacgccgacaatgcagtcagtgtataaaaagcaaagccggctgggcacagtggcttatgcctgtaatcccagcacttttgtaggctgaggccgggggatcacctgaggtcaggagttttagaccagtctgatcaacatggagaaatcccgtctctactaaaaatacaacaattagccgggcatggtggcacatgcctataatcccagcttcttgggtggctgaggcaacagaatcacttgaacctgggaggctaaggttgcggtgagccaagatcacaccattgcactccagcctgggcaacaagagcaaaactccatctcaaaaaaaaaaaaaaattgtagagacaggtcttgctgtgaggacataggctggtcttgaacttctgggttcaagtgatcctcctgcctcggcctcccacagtgctgggattacaggtatgggccacctcacctggccttctttttttcttaatactacaagaagaaatacatatttggccaggcgcactagctcacatctgtaatcccagcactttgggaggccgaggcaggtggatcacgaggtcaggagatcaagaccatcctggccaacgtggtggaaccccgtctctactaaaaatacaaaaaaattagctgggcgtggtggcgcgtgcctatagtcccagctactcaggaagctgaggcaggagaatcgcttgaacccggaaggcggatgttgcagtgagccgagatcgcaccactgcactccagcctgagcaacagagcgagactccgtctcaaaaaaaacaagaagaaatacatatttgatgtacaagatttagagaatgcagatgaacatcaacaacaaaagtgcttattactcaccaaccaaacagagccacagttaacattttcagtatatcaatatgtactagttaaatcacaggaaatagctgttttgggaagtcaaaaatgattgaatatggctcatgctaatcacacatttagatataaatataaatacattatatattaaaatcttctaaaatgggattatttataaatatttatttataacattttgttacttgaaatatatatgaacataattccttgttaatatgtgtagaatctacatcagcatttttggtggcatcttagtatttcaacgtatagatatccaataatttctttaaccaattgtctgtttttgatcacttactgtttcaggtacctatttgtgctaacaaaccacttcacaccccaatgccttaaaagaataatgatatattctgtgtcatgattttgcaggttgactggctgtcctgctgggctttgctgggctcactcacacagctgctgacatcccacagctgctgacatcctacagcttgagtgggcctcgagggccccagatgttctcattcacatgtctgccagtcagtgctggcttgtgagctagggctcctcagttctctacatgcctctgtgtcagcggtctgcaagattaccctcaggcttgatgattcactagaaagactcacaggacccagaaaagctgttatattcatggttagggtttatcatagtgcaaggatactgatcaaaatcagcaaatgaaaaaggcccatgggacaaagtccaagagaaaccaccagtcacaagcttccaggcatctcctcacagtggaatctcatggagacatgcttaattctcccagcagcaatgtgtgagaacacatgcaaagtattaccaaacaggaaagctcacttgaaccttagtgtccagggtttttgttggggattggtcttataggcatgcaatgcccatgttacagacctcggttactcagactccaaccccccagaggtcaaactgatacagcacagcccaaagcgtcaggcatatataaacactctcaggcagaggatttatatcaagcaggctattccaaagtctcagaggttgtcttccccagagccaaaggccagccctttctttagagtatgtaggttttgtgcaactcaagcctaataaattaatcctttactgaacacttctcatcttccagtactgggtctcttcacagcataatcgtctggagattccaagagggtaaaaattgagactgcaaggtttcttaaggcctaatcttggaagtcacacaatatcacttctgatacattccattggccaaagcaagtcacaaggccaatccagagtcaaagaagaaggagcagcagtgttacattgcaaaaataagaccaacgtggggtggtataatttattggagacattataacaatctactgcacatacaatttttagaattatttactgctataagcaaggccatgataatcatccttattcaatagtttttccagtttataatacatttgccttctttttttgtcttttttcttatttatttgtttttgagacaggagctcacttttcacccaggctgcagtgcagtggcatgcccacagcttactgcagcatcaacctcctggactcgggtcatcctcccacatcggcctcctgggtagctgggactacaggtgtgtgccaccatgcccagctagttttttgtatttttggtagagacagggtttcaccatgttgcccaggctggtctcaaactcctgagctcaagcaatccccccacctcagcctcccaaagtactgggattacaggtatgagccacagtgcctggcctgattttcttttttttaatgtattatgaagtattccatatacacaaaaagtattaaaacaacataaaaagcaggtaggtgtaacaggtttaaagatgtgtagtcttataactgtgtagacttttactttgcaattataggttttacatatataggatatagagcaaatgtatttattctctataaaagtgtccatttctgccacttaaatatacttaatatgtaatttgtatatttctacactccacagtaaggaaatataaaatggaaaacctgtaaatgttttacttgaataagtagtcagaagataaattagaaagaaaatttttaacattaatataaatgtatttttgaattggtatatatatatattttgagacggagtctcactctgtcacccaggctggagtgcaatggcatgatatcgcctcactgcaacctctgccatccgggtccacacgatccttctgcctcaggctcccaagtagctgggattataggcacacgccactacaccagcttgattttttgtatttttagcagctatggggtttcaccatgttagccaggctggtctcgaactcctgaccacgggtgatccacctgcctctgcctcccaaaatgctgggattacaggcatgagccactgtgcctggcctgaattgatatatttttgaaagcactatggaagtttgcttttaataaaaattaccatctgaattttaaaatttttttaaaagaaaaatatgatggtatgcacttatatttttgcacatatatgagtggttttcttaaggtacactccaagagtaaaatatatacacttttttcttttttttcttttcttttttttttttagacagtctcactctgtcacccaggctggagtgcaatagtgcaatctcggctcactgcaatctccacctcccagattcaagcgattctgctacctaagcctcccaagcatctgggattacaggcgtgtgccaccacacccagctaatttttgtatttttagtagagacagggtttcaccatgttggccaggctggtctccaattcctgacctcaggtgatccacctgccttggcctcccaaagagctgggattacaggcatgagccaccatgcccagccgtatatacactttttgaaaattttatacaagttgttaaactgccccccaaacacactatcataatttaatgttgcgcttccttctcaacattgagtatcatcattcttcttaacttttgctgccttgataagtgaaaatatctttttgttttaatttgtatttctttgaatattaggtttttttcatttatttaataatcatctgtattccttatttttgttaactttctttaatataagtttttcccaattttatttctgcacttgatctttttccttttgcgtttgtttgtttgtttttgagacggagtttcgctcttgttgcccaggctggggtgcaatggcacaatctcggctcaccgcaacctccgcctcccaggttcaagcaattctcctgcctcagcctcccaagtagctgggattacaggcacacgccaccgtgcccagctaattttgtatttttagtagagacagggtttctccatattggtcaggctggtcttgaactgccgacctcaggtgatccatctgccttggcctcccaaagtgctgggattacaggcatgagccaccgcgcccgtctcctattgctattaatggttctttttatatcaggatattacctggttatctgcccattcagaactttaaaactactttttccatgtaggctgatgaaaagaaaaaaggaaaaaaaaaaagaactttaaaagtacagtgagatgcacgatctgatattatcttcacaaggctcccatgaaaaaggtatgaagactgttattcttaactccattttataaatgtggaaactgaggcttagaaaaatatgtgccgagaatcgcttaaacccgggaggtagaggttgcagtgagctgagatcacgccactgcactctaacatgggcaacagagcgagactttgttaaaaaaaaaaaaaaaagaaagaaaagagaaagaaaacaaaagaaagaaagaaatagagagaaaagaaagaaaggaaggaagaaagaaagaaagaaaaagaaagaaagaaagaaagaaagaaagagagaaagaaagaaagagagaaagaaagaaaagaaaggaagacgcccatagtgatggagtgagtttgcggagaaattgagggcagaacccaggcttccgtctcctagcccagagtgctttctcaacaccactacaccactgggactgaaacaggtggtttccctagaccttcttgcaccaatgacattctagaagcaggggtgaccttttgggacaaggacttgcagcttttagccccaacaggcccagtcctctaagtagaatatgaacaacatcactgggagggggccagcagatactggctttcccctcctgctggccatagtgagagattgacttcgaggaaacaagtggactggctgaaggtcaaagcttgtaaaactgaaaaagaaaagacctatcatttcttccctccccctagcaactccattgagtctaagcatgctttgcagctggcttgcagaggtcaaagcgtttggaggagagatccatttatctttacctttctcaagtgactgtggttaacctgtcaccagggcagaagaccttgcactcctcaatcaggacacctacaacgtgggagtggggcggtagctgggggggggtgtcaaatccagcttttttcagcggctgcagcctgtttgcccatcaacaccccaccagtgtgtatgggagcgtggctctggcctccttcttgcctgagcagcagccagcaaacatttgcccttcctcttgaagacagcctttgccacatgcttccttgcatgagaagagtgtaaagggaagaatgttcttctgttttctccattgtgtagacagcaggatgagctctgccctgcccccaactccaccactaacattctgtgagacttcaggaagttcctggccttctctgaacctcagttttcacctctgaatgttaaaggtttggactggatactctcacaggaccctgtcagtcctgacattctgggattctctatctgtttgctaacctgggtatctgagtatcagatttgggtaaagccaagatcgcctctgtagaaaagtcatgggtatcaagaaggcctcagatggaacaaacagaggacaaacactgtgaggcgatgccagaggacccagtaagatttcaggggtttggtagcagcaaagaaactgacccagacaaaccaataggcccagggtagggacaaagcgggttcccaaggggcctggtggctggaatcaagaactagggctgagtttcatgcttatctgctgagaggctcctgccttccagggaggtagccgaggtgtattagaaggaaaaaggagtgttggactgtgtaatgtggaacaagtcacttatcttctctgagccttgatttccttaccagtaaaatggagtcaacagtcctagccaacaagtgcataaaaagatgctcagggggccaggtatagtggcttaagcctatgagcccagcactttgggaggctaaggcaggaggatcacttgagcccaggagtttgagaccagcctaggcaatagagaccctatctacacacacacacacacacacacacacacagaattagaaggatcactttttttaaattttttgtttaaaaaattgtaaaaagttattctcctgcctcagcttcctaaatggtgacatgtacctgtagtcccagctactcaagaggctgcggcaggatgatcacttgagcccaggatgttgaggctgcagtgcactccagtctgggcaacagagtgagaccctgtctcaaaaaaaaaaaaaaaaaaaacctcaacatcattagtcattaggaacatgcaaattaaagccacagtgagatatcacctaacacccagtaggatttaaaaaataacaagtgttggcaagaatgtggagaaattgtaaccatcatgcattgctgatgggaatataaaattacacagcctttgtggaaaacagtttggtggttcttcaataagttaaacacagaattaccatatgacccagcaattgtaaccttgggtatatatccaagacaattgaaaacatttgtctacacaaaaacttgtacacgaatgctcatagcagcactattcataatagccctgatatggtttggctgtgtgtccccaaccaaatctcactttgaattgtaataatccccacgtatcaagggtgggaccaggtggaggttaagtgaatgatgggagtggtttcccccatgctgttctcatgacagtgagtctcatgagatctggtagttttataagcatctggcatttcccctgcttgcactcattgtctctcatatggccctattgtaagtttcctgaggccccccagccatgcagaactgtgagccaattaaacctcttttctttataaattacccagcctcgggtatttcttcatagcagcatgagaatggactaatacagtaaattggtaccagaagtggagtgctgctataaaaatacccaaaaatgtggaagtgactttggaactggataacaggcagagattggaacagtttagagggctcagaaggcaagaaaatgtgggaaagtttggaacttcctagggacttgttgaatggctttgaccaaaatgctgatagtgataaggacaattaagtccaagctgaggtgtcttggatggagatgagaaacttattgagaactggagtaaaggtcactcttactatgcttttgcaaagagactggcagctttttgcccctaccctagagttctgtgaaactttgaacttgagagagatgatttaggttatttagcagaagaaatttctaagaagcaaagcattcaagaggtgatagagcataaaagtttgaaaaagttgcagcctgacaacacagtagaaaaggaaaacccattttctggagagaaattcatgctggctgcagaaatttgcataagtaacaaggagccacatgctaatcgccaagacagtggggaaaatgtctccagggcatgtcagagaccttcgcagcagcccctaccatcacaggcctggaggcctaggatggaaaaatgatttcctgggctgggcccaggggccccctgctgtttacagccttgagacttggtgccctgcaccccagctgctccagccttggctaaaaggggtcaaggtacagctcaggccgttgcttcagagggtgcaagtccaaagccttggaagtttccatgtggtgttggtcctgcaggtgtgcaggagaaaagaattgaggtttgggaacctctgcctagatttcacagcacatatggaaatgcctggatgtccaggcagaagtctgctgcaggggcagagccctcatggagaacctctgcttgggcagtgtggaagggaaatgtggggttggcgcacccacacagagtccccactggggcactgcgtagtgaagctgtgaaaagagggccaccatcctttagaccccagaatggtagatccaccaacaacttgcactgtgtgcctagaaaagccacagacactcaatgtcagacgtgaatgcagctgggagaggggcactgtaccctgcaaagccacaggggtggagctgcccaagggggtgagagccctcctcttgcctcagcatgacctggatatgagacatagagtcaaaggagaccattttggaacttgactgccctattggatttcagacttgcatggagccagtagcccctctgttttggccaatttctcccacttggagtgagtgtatctacctaacatgtgtaccccattgtatctaggaagtaactaacttgcttttgattttacaggctcccacgtggaagggacttgccttgtctcagatgagactttggacttggacttttgggttaatgctggaacgagttaagactttgtgggactgttggaagggcatgattgtgttttgaaatgtgagaacataagatttgggaggggccaggctcagaatgatatggtttggctctgtgtccccactcaaatcttgctttgaattgtaataatccttgtgtgtcaagggtggaaccaggtggaggtaattgaatgataggggcagttttccccatgatgtttttgtaatagtgagtgagcctcacaaaatatgatagtttttataagcatctggcatttcccctgcttgtactcattctctctcctgcggccctgtgaagaggtgccttccaccatgattgtaagtttcctgaggcctccccagccatgcagaactatgagtcaattaaacctcttttatttataaattaccgagtcttgagtatttcttcatagcagcatgaaaatggacaagccccaaagtggaaatagcccaaatgtccaccaactgatgaacagaaacatgatatggtaaatccacaatcataaaaaggaatgaagtacagatacatgctataacatggatgaaccttgaaaacacgatgctatgtgaaagaagccagacagaaaagaccacacactgtatgataccatttatatgaaatgtccagaataggcagatcgatagagaaataagtcaatttttggttgccaggagctggggtaaatgggggtttaggtgaatgacagctaaatgacagctaaaagatacagggtttctttttcttttttttttttttttgagatggagtctctctctgtcacccaagctggagtgcagtggcacaatctcagctcagtgcaacatccgcctcccgagttcaagtgattctcctgcctcagcctcctgagtagctgggattacaggcctgcaccatcatgcccagctaatttttttggtatttttagtagagacagggtttcaccatgtcagccagtctagtcttgaactcctgaccttgagtgatccacctgcctcagcctcccaaagtgctgagattacaggcgtgagccaccgcgcctggccagggtttctttttgagatgatgaaaatgttccaaaattgactacagtgatgattgcacaactcttcatacaccaaaaactattcagttgtaaagtttaaatggttgaatcgaatgatatgcaaattatatctcaataaagctgtttactaagacaaaagagtccttgccaagtcattcttacaggattggtgaaggactcaatgaaagtaaaatcttttttccctgcccagaccaaaccatacttttttagtttgcttttttattgtgaaatataacacttgtacagaaaagtgaataaagctgaaatgtacaatttaacaatttatgctaaagcaaatgccaccctattcaagaaatacaaaattggaagcatccagaagcttttccaaatggtattagttttctcgtacttccataacaaagtattacaggctggggggcttcaacaacaaaaatgcatcatctcccaattctggagacttgaagtccaagattaaggcgtgggcagggttggttcctcctggggcctttctccttggtttgtagatggtgtcttctccatgtgtcttctcttggtcttctctcttagtgtgtgtgtcctaatctccttttctttcataaggacaccagtcatattggaatagggtctaccctaatgacctcattttaatttaatcaattctttaaaggctctctctccaaatacattcatattctgaggtactggggattaggacttcaacatataaatttgggggggatatgacacagctcataacacctcccatggtaataatctccctcatcccctaccaggagtgaacactactgtgacttttagagtaaccattacttgcctttctttatagttgagccatctctgtgtacatctctaaacaacagagtttaattttgcctgtttatgaattttgtatgaacagaatcatcagcttctttcacttaacatgatgcttgtgagattcatccatgttggtgtgggtagctgaagttattcatttccactgtatgaacacactacaaatgacttatttattctcttttcgacagacatctggattctttccagtttgggcctgtaacaaacagtgctgctgtgaagatgtctcctggacgtcacatgcctacccctctgtaaggtgcacacttaacttgctaagtaatgctaggctgtgtttcaaagtagtcataccaatgtaaattcccacgaatttacaaagagcagcctgcaagctctctttgctccttgtcttcatcaatgcttagaaatgtcaaacttgttaattttggtccttctgatgggtagctgatggtatctcgttgtgattaagtttcatatttgtcattactaatgagattggacacattttcatatgcttattggccattaggtatcctcttttgtgaagtaattgttcaaaccttttgcccatttttctacagggttgtctttctcttattaattcttaggcattctttatatattctggatgcaagctctttgcagttatacgttaaaatttctcccactcaaggttgcctatcactctcttaatgatgtcttttcatgaacagaagttcttaatgttgatgtagtgtaatttaccagtcttccatggttagtacttgtttgtgtgtcttgattacaaagtctttccctaccttattttaggaagatattatcccaatattaccttctaaatgtgttcttgttttacctttagtcttgccttaatatataacccacctgcaatttgtttttgtgtgtgatgccaggcagggctttaattttatttttttatatgactctttaattgtcctagcactgttaaagatttgtctgagcacagtgacacatttgtcacatgtcaagtatccatgcatgcgcttggtggactctggactgtgactctttgtcctaacccctggaggcagccacaagtgaagatcagcccctcagctgcttcttctcgggtcagcaaaccccaaaccactcagggcaaaggcacttccactgccaggctcacctttcaggattccctttttctctcagatcttggtttgttatacttttgtagctatctagttagctcactgatgtttttaaggtgattttcccccagtttttttaaaacgggagggttggtccaaattatctagtctaccattatcagaaattaaagtatagaacatgtacatccttttcgataaaatgcataacattttattaagggataatgtacatatagcaatgtattagtccattctcacagtgctataaaatatgagattgggtaatttataaagaaaggaggtttaattgactcacagttctgcatggctgaggagacctcagaaaacttacaatcatggcagaaggggaagcaaggcacctattacacggtggcaggagacagcaggagggcgggggaagtgccacacttttaaaccatcagatcacgctagaactgactcactatcatgagaacagcacgggaggaaccgcctccatgatccaatcatctcccaccaggtccctcccttgataggtggggattacaatttgagatgagatttgggtggggacacagagccaaaccatatcaagcaaggtgcataaagtttactaatcttaactgtacacctaggtgcattttatatatgcatacgcccatgtagcctctgttcagataaagacaaaaaatggttcaagcactccaaaagatttcctcattccttttcccagtcaggacaccactcccaggaatagccactattgctatcaatattttttgtctgttttgagcttcgtataaatggaatcatacgtactctttttttaacttttattgaattttttgagatgggtctcactctgtctcctaggctggagtgcagttgtgtgttcatggttcattgcagcctcaacctcccaggctcaaatgatcctcctgcctcagcctcccaagtagctgggacaacaggtgcatgccacaatgttcagcaagtttttttttcttttttgtagagacaaggtcacgctatgttgcccaggctggtctcaaactcctcagctgaagtgatcctcccaccttcgcctccaaaactgctggaattacaggcatgagccaccatacatgggccagtatgtactcttttttattttttgagacagtttctcactttgttgtccaggctgcagtgcactggaacggtcatggcccactacagccttgacctcccaggctcagttgatcctcccacctcagcctcctgagtagcttagactacaggcccattccaccacacctggctaatattttgtacttttttagagatggggtttcaccacatcctcaagctggtctcaaactcctggcctcaagcagtccatcctcctcagcctcccaaagtgctgggattacaggtctgagccaccacgcccagccatgtactctttgtgtctagcttttttaattcaacattgtgtctgcaagattcacccatgttattgcatatacctgtatcacataatctttcactgttgcactgttttccactgtatgaatataccacaatttatttacactttatatcattgattagcatttgtattgtttgtagttttgggctattataaatgtgcccattatgacagtcttgttcatgtcttgtgagtgtgtacccaatttctcttggacataaacacctaggaatgcaattgctacattataggaaatgtaaatgttgagttttaataaacactaccaagcagtttttcaaaatgaatctacaattttataccctcaccagcattgtatgagagagagtgccccacttgctctacatcctcaccaacatttggtgttgtctgtcttttttattttagccattctggtgagtctctagtgatacctattggagttttaaaatacattttcctatcagctaatgagcagattttcatgtgcttattggccaccctggtttttttaatggtagacctttaatttcctttctaatctgctaataattatttctgtcctcaagttttctagtttttcttgggtccatataagtattttatattttactaagaaatcatacttcagcttctatattttaaaattcattgccaaagagtttataacagttttattgagatataatacacatactataaaattcacccattttaagtgcataatttgatggtttttggtatacagagttgtgcaactatcaccactatctgattttagaacattttagtcacctccccaagaaaaacctgtacccattagttgtcactttccattttctccccaacttcagcacccttcagctttaggcaactcaaatgctcatcagaaaataaataatctatggtatatatgcacaatggaatattatacagcagtcaaaatgaatgaactaaatcaattcctacaacatgaataaatctttgtgatgtaattttatgtgaaaaaataaactttaaaaggttgcatatatatatacagacacacacacacacgttggaatattattattcagtcttaaaaaacaggggaaatcctgtcatttgcaacaacatggatgaatctggaggacattatgctaaatgaaataagggagttacaaaaaagacaaataccacatgatatcaattatatgtgaagtctaataaagttgatctcatagaggcagagagtagaagggttgttgccagtggtgggaggaatgggaagggagggagggaatggaggtaatcaaagggtacaaagtttcagacagacaggggaaatggattttgagatctattgcatcacagggtgactatagtcaataatagagcattttacacttaaaaataactaagatagtaaatttcaaatgtctcatcataaaaaataataggtggctaggtgtagtagctcacgcctgtaatcccagtactttgggagtccaaggtgggaggatggcttgaaaccaggagtttgaggctgcagtgagctatgattgcaacactgcaccccagcctggagacagagcctcactctgacacccaggctggaatgcagtggcatgatcttggctcattgcaacctacgcctcctgggttcaagcaattctcatgcctcagcctgccaagaagctgggattacaggtgcgtgccaccatgcctgcctaatttttatatttttagtagaaacagagtttccccatgttggctaggctggtctcgacctcctggtctcaagcaatccacccgccttggcctcccaaagtatgggattacaggagtggaccactgcacccagccagaccctgtctcttaaaaaataaaagataggccgggcgcagtggctcacgcctgtaatcccagcactttgggagtctgaggggggggggggtggatcacaaggtcaggagttcaagaccagcctggccaatatggtgaaaccccgtctctactaaaaatacaaaaattagctgagcatagtggtacacacctatagtcccagctcctagggaggctgaggcagaagaatcgcttaaacccgggaggccgaggttgcaatgagccgagatcacacactgcactccagcctgggtgacagagcgagactctatctcaaaaataataataataaaataaaataaaaaataaaaaagataaataagcgaagtgatggagatgatgtgtatattaactggcttgatttaatcatgccacattgtaaactatatcaaaatataacattgtatcctataaatgtatacaattatgacttgccagtcaaaaataatattaataatacattaatttttaaaaaattcaaagattgtatatggaatggtgccttttaataaagttaacgcaacaaaaattgtaaaatgttgtactttggaaagtatacaaatatgtgtacacaaaacatttgataatattatatgaaaagaaagcaagagaataataaagaatttaggatgatgcttcccttgagtagaggcaaacaggaagatagactggtgggggaatgtcatgtaggttattgtcaagatcatagctttccatttggtgtggtagggtcatgagtgccaattacattactaaaaatacatacatacgtaagttgttcatttatagcctaatgttgagtgtttcatcaaccaaaaattataagtaattcaattctgtgtgcttgagactcaataaaacataaagtagggaggattaaataaggttatgtatgtaaagcacttacaaccaggtgtggcatataattagtgttcaaaaaagtgttcgctgttgtaaatttaccttctaaaagcacttacaagcgcacaaagatatatgaacaaggatgttccctgaagaatgtttaatatgtggttttaaaatttgatacaatcactgggcacagtggctcacgtctgtaatcccagcactttgggaggccgaggctggtggatcacgaggtcaggaatttgagaccagcatggccaacatggtaaaaccccctctctactaaaaatacaaaaattagccaggtgcagtggtgcgtgcctgtagtcccagctacctgggaggctgagacaggagaatcacttaaacccagggggcagaggttgcagtgactcgagatcacatcactgcactccagcctgggcgacacagcaagacttcgtctgaaaaacaaaaacaaaaacaaatcgatacaacctgaataaaagcatggagaattatttctaggccttgaaacataagcaaggaactcccattatttacctggctgaatttcagaattgctatggatcaatgactctttcgtgcctcccgttttccctgctttttgaacaggaatgtctatagtggttatcccaccctatacgaccattgtatattgggaaataggcagaaataaattgtctgtagatggagaaggactgcactccaagtgttgtaattaaggaactatagccaaggcgcttcatccacacctggacctggtttagataatgagattctggacttgaagccaatgctgtaatgggatgagagttttagagatctttggataagtgaatgtattttgcttgtggaaggaatgtgaatcattgcaggccaggtggcagcttttgacatggcttccaatgatccccaccttctgatgtttatgcctttatgtagtattctctccttgagtgaggactggacctagtaacttgcttctaatgaatagaatacggcaaaggtgctcagatttcacttctgagattaggttccaaagagactgtgacttccatcttgctcacacacactctctggatcttctcacttgatccttctggatgaatcaaactgccatgttgtgagatgccctacagagggacccaagtgacaaggaactgaggacagcatccaatcaacagcaagaaactgaacactgcatctgtacatctactccctgaatctaaaatgaaaaataaaataatcaacaatgaaaaaaataacaataaagaagaagaaaataaaaagaaactgggccaggcatggtggctcacccctataattccagcatttgaggaggccaaagtaagtggattatttgagcccaggagttcaagaccagcctgggcaacatggcaagaccttgtctctacaaaaataaaaaataaattagccagttgtagtgacctgggcctggggtcccagctcctcgggaggctgaggcaggaggatcccttgagcccaggaggttgaggctgcagcgagccgtgattgcaccactgcactccaagctggacaacagagaaagaccctgttgcaaaaaaaaaaaaaaaaaagtgagagagagagactgggtgtggtggctcacacctgttatcccagcactgtgggaggccaaggctggcagatcacctgagatcaggcggtcgagaccagcctgaacaacatggtgaaacccccgtctctactaaaaatacaaagattagctgggcgaggttgtgcacgcctgtaatcccagatactcggaggctgaggcaggagaatcgcttgaactggggaggtagaggttgcagtgagccgagatcatgccattgcactccagcctgggtgacagagtgagattctgtctcaaaaaaaaaaaaaaagaaaggaagcaagaaagaaaaaagacaaagaaacaaaagaaagaaagaaggccaggcacactggctcacgcctgcaatccctgcattttgggaggctgaggcaggcagatcacgaggtcaggagatagactctcctggctaacacagtgaaaccccgtctctactaaaaatacaaaatacaaaaaaatacaaaaaaaaaaaaaaaattagcctggcgtggtggcgggcacctgtagtcccagctacttgggaggctgaggcaggagaatggcgtgaacccgagaggcagagcttgcagtgagctgagatcgcgccactgcactccagcctgggcgacagagcaagattctgtctcaaaaaaaagaaaaaaaaagaaaaagcaagcaaaacagatggaaggaaggaaggagagagagagagaaagaaagaaagagaaagaaagaaaaaaagaaagaaagaaaaaagaaggaaagaaagaaactgaacactgcctagaatcatgtgagtgaacttggaagcaatcctcctccagtcaagctttgagatgacagcaaccctggccaataccttgattacagacctcaaaccaaaggatccagctaagcagtggattcctgacacacacacagctgtaagataataaatattattttaagtcactaaaatgtggggtaatttgtcacgcagcaataaataactaatacagttcccaagaaaggaaactacttggactttcccagtacacactgtgtttctcctgtgtctttgcatgtgctcttcccattgttcttcatttggctaacccttctacctttaacaaatagctcaggcatctcctcctccaggaagacttccctaatggggcactgcataaattgttccacttccttactatctagttactatctaggagccttggctgacttttttttttgagatggagtttcgctcttgttgaccaggctggagtgcaatgacataatctcggctcactgcaacctctgcctcccaggttcaagtgattctcctgcctcagtctcctgagtagctgggattacaggtgcctgccaccatgcctggctgatttttgtatttttcatagagacggggtttcaccatgttggccaggctagccttgaactcctgacctcatgatccgcccacctcagcctcccaaactgctgggattacaggtgtgagccaccgcacccagccttggctgacttctatcagcacaattatcacactgcgttttaattgtctgtttcactgcagcagtctatgaattactcgaaggccaggatcatgacacagtgccacgatttccatatcctcagcttccagtgggaggcttggcacatagtatgtactctatagacatagttcacaggctttggagtcaatgggtatcagtttgaatcctagctctactcccagctatctgtgtaaccttagacaagtcacttaacctctctaaaacccagaccttctcattcctggagttgggagtttggggtacgagcagcatgaggaaggggaatccatattcttgctcttcctgctttataggcactgcactacttgatgtttattctacaatcccatgaggcctcttagtcttaggatgatcttcaatgtctaaattgaggtagaaactttggggattatgctcctcaatcagcttcttttatttaataaattaaatatatgcagaagagagttcttgatatagaagttaaaagcagctacagcaaaagaggattaaaaaaaaaataatggctggcggggcgcagtggctcacgcctgtaatcccagcactttgggaggctaaggcaggcagatcacaagttcaggagatcgaaaccatcctggctaacacagtgaaaccccatctctaataaaaaaaacaaaaaattagctgggtgtggtggcgggcacctgtagtcccatctactcgggaggctgaggcaggagaatggcattaacccgggaggcagagcttgcagtgagccgaaatcccaccactgcactccaacctgggcaacagagcgagactccgtctcaaaaaaaaaaaaagaaaaaaaaaatcatggctagcccagtatttttaagtgacatatttcagccttctgctaatgtttcatcactgaaatatcagccctttttcatgtaaactagtgagggtttggacagaggacaaaagcatcatatgttctacacatcttgcaatgggaactgtcaaattttgtgttcaacattgccacagtatcgccgctgacatgcttccaaaagacttttcaaacaaaaacccaccacaggcctggaacaaaatacacagcctagaaaaatgtgcatctcatatttcctacgtggattgacaaaaccaactggggcctgagaccaaaaacagaaaggttttttgaggttttccacaaatgctcccagtttagaaacaaaagtgtgagtgtggaaggggaaatcccccttctagcccaaaggatttaatttccctccagggaaatttctagctctgacaccctcataagactgtaccatagcagacggatcgcaccaggatgtagaagcaggagatttccctagagggaaacttgtgggaaatagcctgaaaatgcacattcaaatcaagtcttaagagggaaagggagatctgcttagactgacagcacaaatggtctgtgattccaagttacaaacctttccctccggagaagtgtgaacttggacctgctactctttctgaacactgcacagcctggagatgatcccccctcaatgcttctcctcttggctcttttttctttttccgtttgttttgttttgttttgtttgagacagggtctcactctgccacccaggctcgagcacagtggtgggatcacagctcactgcagtcttgatctcctgggctcaagtcatcctctcaccccagcctccaaagtagttggggccacaggcgcatgccaccatgcccaactatttttgtttgttttgttttttgtattttttgtagagatggggtcttgctacaggctggtctcaaactcctgtgctcaagcaatcctcccccttcggccttccgaagtgctgggattacaggtgtgagccacagtgcccttccagggctttatctttttgaaagactccacaatccctccagtgccccaggagagaaaactagactccttttttttttttttttttttttgtgacggagttttgctcttgttgcccaggctggagtgcaatggctcgatctcggctcaccacaacttccgcctcccaggttcaagcgattctcctgcctcagcctcccgagtagctgggattacaggtgcccaccaccacgcccagctaattttgtatttttactagagatgggggtttctctatgttggtcaggctggtctcaaactcccgacctcaggtgatccacccacctcggcctcccaaagtgctgggattacaggcgttagccaccatgcccggcctggactcacttttaacttctccttcttcctcatcccccacatccaatcccccaccaagttccagcaatccttatttcctaaatgctctcttgcccttttttttttcagtgtgaataactttttaaaaattgtataattattgtatatatttaaggtacacaacatgatgttctgatacacatatacttagttaaatgtatatacttatatacatatacttagttaaaacactcaagccaattaatgtatccatcatctcacatagttaactttttttcctggtaagaacacctaaaatctactctcttgacaaaattccagtaaataatacaatattattaactatagtcctttactgtacattagctgctctctagacatattcatcctacacaatgcaacctatcacctcacacctgttaggatagctattatcaaaaagacaagagataacaagtattggtgagagtgtggagaaaagggaacctttgcaaccacaatgagatatcacctcgaaattctttggatcactattttccaaaaaaaaaaaaaaaaaaaagaagtactggcaagagtggagaaagggaactcttgtacattgttgatgggaatgtaaattggcacagccatgatggatggaaaacagcatggctcttcctcaaaaaattaaaaatacaactatcacataacccagcaatcccacttctaggcatatacccaaaggaaatagtcggtacctggtagggatgcctgcactctcatgttcattgcagcagtattcacaataaccaagatatggaatcagcctaagtgtcccttgatcaatgaatggataaagaaaatgtgctggtgcggtggctcacgcctgtaatcccagcactttgggaggccaaggcaggcggatcacttgaggtcaggagttcaagaccagcctggccaacatggtgaaaccccgtctctactaaaaatacaaaaattagccaggtatggctgtgcacacttgtaatcccagttacttgggagactgaggcaggagaatagcttgaacccgggaggtggaggttgcagtgagccgagatcacgtcactacactccagcctgggtgacagagagagagattccatctcaaaaaaaaaatgtggtaattatacacaatggaatattatccagtctttaaaaaaagaaaattctgtcctttgcaacaatatgaatgaaattgttaagggcattatgttaagtgaaataagccgggaacagaaaggcaaatactgcatgatcccacttataggtggagtatttttttttaaatacgtagaataatagaatggtggctaccagaagccaggggtgaggggtgggtaagttgcagttatgtgggatgaataagcctagtatctcttgaatccgtctacttttctatatcctcaacgttgccattcttatacgagcccccagcatctctcatctagactcccacaaacacctcaatcccatctccctgaatggcagaaacaatgctatgtgttcacaaatccatttcattctctccctaagcacacagaatgaccacatctccaaactgctcttgcaattcagctggggaccatgggatgtgggcaagagtgatataatgacatttctggggctagccctaaaacccattctacagtggcatgaaggacatgggttgaagatggtggcacaacaaaatggaagaatctgggatccctaaatcacaatgtaaaaggctgcctgccaaatttcctattggactgtaacgtcactgagaagtaaatcttttattgctttaagtcacttagaatgaggattgttctttgtagcagtaggcttatcctgagagcctgcttccacttttgcccctccccatgtcttctaatcagttcccctcacagctaccagaggaatttaactacaatacataactgatcacatcactatccaccactcctcacatccccccatatgaaaattcttaaataaatgctttccattgatcataggaaagttcaaaattcttaagatggcctataatgccctgcatggtctacaactgctgaactttcccctgatctgtccctatttattcactcatttaatcacttattcaataaatatttcttgagcaccaactgtcagtagctatactagttctgggaatagactagggaaaggggaaaacagggaaatcatttgggaagctcttatattcatccagacaaaagacagtaaggacctgagctacagtacatctccagttgtgacatcctggtaagatggcaccataacagatgtcaccagggcatgcatttaagccagaaattcccacggagggtaaaagcctgaaaatgcaagttctagtctatccctaagaaagcataagacagggggaaaaaagaagaagaagaagaagaactaatgaaaaaaaataataaataaataagaaagcatgggagcctggcggggtgcaatggctcacgcctgtaattccagcactttgggaggctgaggcgggcggatcacccgagctcagtagtttcagaccagcctagccaacatggtgaaaccctgtctctactaaaaatacaaaaattagccaggcatggtggcaggtgcctgtaatcccagctacccaggaggctgaggcaggagaatcgccggaacccaggaggcagaggctgcagtgagccagtatcgtgtcactgtgctccagcctggatgacagagcaagactccgtctcaaaaaaaaaaaaaaaaaaaaaaagaaagaaagaaagaaaaagaaagaaagcatgggagaatttacagatgagggattcacctacactgacagcatgaatgagaggggtagatgcatgatattttaggaaacacaattggcaggatttgggaactgactatgaagggtgagaaaaggaagagccaggctgggtgaagaaaacatttgggaaaagatgaagatgatgagcttaggtttaaacatgtggagttagaggtgccaatgggccatccaggtggtatctcaaagaggcaattggatctctgggcctggagctcaaggaagaggcctggtctggtaacgtacaggtaatgtcctcactgatcacaacttctaaagtctcggctatcttgaaacaaaaacaggccagtaaccccagcactttgggaggccaagacaggaggaccatttgagcccaggagttcaagaccagcctaggaaacatagtaagaccccatctctacaaaaaagtaacaaaattagccaggcatgatggttcgtgcctgtagtcccagctactcaggaggctgaggtgggaggatctcctcagcccaggaggctgaggctgcagtaacctgtgattgtgccactgtactccagcctgagtgacagcaagatcctttctcagaaacaaacgcaaaaacaagaacaagcaaacaagccaacctgcttctgctcctcactccgtaccgtgcttcccctccctctctctctctctcttccctccctttcatgatcatacctcctaaaagtggtgtctccactctagatctactctccccacccccttcacgctagagtcacgtctccatctccatcatttttttttacaagccaacacgtataattcacattccataaaattcacccatttaaagtgtacattttttaggccagactcggtggctcacgcctgtaatctcagcactcagggaggccaaggcaggtggatcacttgaggtcaggagtttgagaccagcctggccaatatggtgaaaccccgtcactactaaaaatacaaaaattagctcgtcatggtggcgggcgcctgtaatcccagccacatgggaggctgaggcagcagaatcacttgaactcggcaggcagaggttgcagtgagccaagatcacaccactgcactccagcctgggagagagagtgagactgtctctaaataaataaataaataaggctgggtgtggtggctcatgcctgtaatcctagcactttgggaggccgaggcggtcggatcacttgaggtcaggaattcaagaccagcatgactaacatggtgaaacccggtctctgctaaaaatacaaaacttagccaggcatggtggtgcatgcctgtagtcccagctacttgagaggctgaggcaggagaatctgcttgaacccaggaggtgggggttgcagtgagccaagatcacgccactgaactccagcctgggtgacagagcaagactccatctcaaaaacaaaaaaaaattaaatttaaaaatgtaaaatatttagaaacttcagagttgtaaaccattaccactaattatggaacatttttattatccaccaaaaacctctgtacctattagcagtgagtctccatttcccccaaataactccaagccctaggtaacccctaatctattttttttttttgagacagagtctcgctctgtcaccaggctggagtgcagtggctcaatctcggctcactgcaacctctgtctcccgggttcgagcgattctcttgcctcagcctcccgagtagctgggactacaagtgcacgccaccacatccggctaagttttgtatttttagtagagacggggtttcactatgttggccaggatggtctcgatctcttgacctcatgatccgcctgcctctgcctcccaaagtgctgggattacaggcatgagccactgcacccggcctattttctttctgtatagatttacctgttatggacatttcatataaatggaatcatgcaatatgtaattttttgtgactggcttatttagcataattatttcaaagttcatctatgttgtaacatgtatcagtacttcattcctttttatggctgaacaatatttcttcatatggatataacacattttatccactcatcacttgatggacatttgggttgtttccactttttggctattaagaattatgtacatgagccaggcacggtggctcacaactgtaatcccagcactttgggaggccgaggcaggcggatcatgaggtcaggagattgagaccatcctggctaacatggtgaaaccccgtctctactaaaaatacaaaaaattagcctggcatggtggcaggcacctgtagtcccagctactcgggaggctgaggcaggagaatggcgtgaacccgggaggcagaggttgcagtgagctgagatcgcgccactgcacttcagcctgggcgacagagcgagactctgtccacaaaaaaaaaaaaaattatgtacatgaggccagacatggtggctcatgcctgtaatcccagcgctttgggaggtcaaggcgggcggatcacctgaggtcaggagttcaagaccagcctgaccaacatggtgaaaccctgtctctacttaaaatacaaaattagccggatgtggtggtgcgtgcttgtaatctcagctactcgggaggctgaggcaggagattcgcttgaacccggaaggcggaggttgcggtgagccaagatcgtgccattacactccagcctgggtgacagagaaaaaaaaaaattatgtacatgaatattcatgtacaagtatttgtttgaatacctgttttcaattattttggctgtatacctaggagtggaactgatgagccatatggtaattctatgtttaacttattgagaaatctccaagctgtttcccatagcgactgcaccattttacattcccacctgcaatgtaccaggactgtaatttctctacgtcctcaccaatactagttattttccttttttatcttttttttttttttttggcaagcagataaaggcttgttttattttaatggctgatctatgtattcacggaggccagtatgtacagacaaaaggcgagcttttatttcttggtgtcttcctccttgaacaaagtcttgatgatctcctccttcttggcctggaggcgctcttcactgcgcttccgtgcttccttggtcttaggcctgcgggcctcagcctggtcagccaggagcttcttgtgagccttgtctgccttcagcttgtggctgtgttccatgagaatcggcttgtttgtgaacacattcccctgcaccttcaggtacaggctgtgatacatgtggcgatcaatcttcttagattcacagtatcttctgagcagcaggtgcagaatcctcattctcttcatccacgtgaccttctctggcattcgggcattggctgtaccctttcacttatctatgcctatgtgcctgcccttccagtgggccaaggtgtttttctggcatcgagcccgggaatggaccgtcacaggcttgcggatgatcagcccatctttgatcagcttccagatctgctgatgggaattggcattggcgatttcattggtcttattggggtccaaccacaccttcttcttgccacagcgaaggacactagaggcgagcctcttctgaagcctgagcatactcatggctgtagtcgcagcagcgaaaggaaagagctcccttttttatcattattataaccatcctagtgggtgttaagtagtatcctattatagtcttgatttaaatttcttgatgactaatgatgctgaggatttttcatgtgtttattggccatttatacatcttctttggagaaatgtctgttaagatcttttgctcattttttaaattgggttgtctttttattgctgagttgtaatagtcctttatatattttgaatactagatccctataggatatacgttgtgcaaatattttcccccattctgtaggttgtcttttcactttcctggtggtactgtttgaagcacaaatgttttgtttgttttaattttaatgaagttcaacttatctattgttttctttagttgcacatgcttttggtgtcctaagaaactattgccaaatccaaggtcatgaaattcacacttatgtttcctactaagaattttatagttgtagctcttacatttgggtctttcatctattttgaattgatttttgaatgtgctgtgagggaagggtcaaaattcattcctttgcacatggatatccagttgtcccaacatcatttgttgaaaattatttcccccattgaatgttatttttatccccattgaaaaatcagttggccacaaatgtctgggttcatttctggactcacaattgtattggcctatatgtctgtccttatgctggtactacaccgtcttgattattgtagctttaagtttttgggttttttgtttgtttttgtttttttgagacggagtctcagtcactctgttgcccaggttagagtgcagtggccacagtcttggctcactgcaacctccgcctcctgggttcaagcgattctcctgcctcaacctccggccagagtagctgaaactacaggcatgcaccaccatgcctggaattttttttttttttttgtatttttagtagagatggggtttcatcatgttggccaggctggtcttgaacacttgaccttaagtgacccacctgcctcggcctcccaaagtgctgggattacgggcatgagccactgcacctggctttgttgtaagttttcaaatcaggccaggtgcagtggcttacaggtgtgctgtaatccctacactttgggaggtcgaggcaggaggatcgagtccaggagtttgtgaccagcctgggcaacacagtgagaccctgcctctaaaagaaattaaattagccaggtgcggtggtgctacttgtagtcccagttacctgggaggatgaggtggaaggatgccttgagcctgggaggttgaagctgcaatgagctgtgattgtgccactgcacaatagcctggacaacagagcaagactctgtctcaaaaaaaaaaaaaaagttttaataaagtagttttgaaatcaagaaatgtgaatcctccaactgttttcaagattgatctgggtatctcctgcatctcttgaatttctatatgacatttagaatcagcctgatttctactagaggaagccagctgggattctaatagagattgcgttctagatcaatttcaggagtattgccatcttaacaatattaaaccttcccattcatgaacgtggaatgtctatttccttaggtctttaatgttttgtacttttccccatgtaagttttgcacttatattgttcattcctaaatattttattctttttgatgttattgtagatatttaagagaatgttttcttagtttcagattgttcatggctggtatatagaaatactagtttttgtatgttaatcttgtatactgcagatgatcaattcatttttctagcagttttatttggagattccttacggttatctgtatacaaggtcatatcatctacaaatagacatagctttgtcttctcaatttcagtctggatgttttctttttcttttgcctaattgccctggctagaacttctagtacaatcatgaataaacccatgggttttcctaaacgtcctatatcaggttgaggaagttcccttctacccttgtttttatcatgaaagtgtttgtcaaggtttttgtgtctattgagatgatcatgtgtgtctttttccttttattgatatggtatcccagcttcttttgaaagctgaaatcgtaggatgcccaacatataaaacagggtgggaggctgctctggttgaagcagtaagggaagcttggggccgccaagctggctcaatggcctttccttaccaggtagccttgggctccacagaaaactgagctgggagccaagaacagcaagcggtccctgtggctctcctccagaactccttgttgggcatggctgagtcagccaactaagcccagacccttggcctcgaggagccctgtgggcagggctggctgattacaagtacccaaccactttatcaaatagtagctcgttagcatcctgcaaattgcctatttatcctggtccagggcttcagagccaactcccccttatgcctcgggccaggaggttgatcttggggctttggagtccttaacacttaagtcattttgatggtatcattccactaaatgttagtagttcagatctatggttaccacaaagtttgcacttctaaaaccttgatgataatcaaccaaaagtacagaggttcagtatctcagacagatcgcagacagcccactgattactttttgggaagagtgattaagaaactttattacagaaaatgaatgcatccaacgtccccaaatacatttgtgacaagaacagacacacacaggagacacagacaatagtcactacatcacagccttgttctttccgaaggataaaatgtcattcaagaatggggtgaggtggttagagggagtaggtactatccttttaaatgggggaaaaaaaaaaaaaaagcaacaggttggcatcttaagaacacagacagtgggcccagaaatcaagctaagcctaagccttaggtaacatcatgccacttacatcatctcagagaaactagggcattattccactagaagagcaatcttgccacagtgtgaaaacgttgagtagtgatcttgctgccccagctaatggaccaagtggcctcaacttgacagcctctttaaaactcaatgtttgcctaatcaaagatcatctggctaaactgctcccccacttctgcttagctactttggaagcacaaaagttacccctttccatccttggcccttccctggttggtacatctagttatgagatagacgcgcaccacttaacaaatcactcccttttgaccgcaggttgtttctcttccatatttgacgaggctggcaacagctcccgaatcttggcctagcacatcacgaattgggaagctaaagctttagcttagaatgccaagtgacaaggacatggctgaagcaggaggggaaattctggaacaagtgcctctgggcaaacctcacaaccgagttttttaaattagtggtcattttctagaactagaggaacacattcaggacaaacagttctgatgggagagcgaatggctatgaacacataagagatcaggctgtgaccgtgaccataactcgtactcatccaggacccgacagggcggagaggacaccgcctccagacatgcaagtttctcaacagtgaattttaagaaaaagctgctttctcttaaaattaatagcacaaaaacactcctgcgtgtttcatagcctcaaacatacacacccaaatattaatgctgggcaatagcaacactcacccacaacacagtactgtatccttcattgctacggacagtaatgatgtatatacacatcagccttcaaaatggtatttagtgtcaccacttgctactgtggccatctcccctcaccccaacctggataaaatgttacactacccactaatataaccactgacacacaaaccaagctccttccagtttaacattgaacatcaatctacatttccagtgaatgagctaaacttatgagcaggccattcaacttttcatgatacatttagtgctcagaaatggttgattccattagcctgccctatagctcaggtggcccaagatggagcctatcatcttccttggggtgtttggtgtttccaagtaggagcaaaaaaaggataccgtcccctaccccaccaccccatcccacataccctcactggcatccaggagaccagcagcaggctcaagaccccaaatgttgggcaccacaaataatgtgatatgtgccaggagcacggggggtaggggtgaaagagaaaaacaataaggccttaatttttgacacaccatacactctgaaattgctgtttagcaatgcatttggccccacaaaatagggggtggaggtgggacaaaagttaaacctagatagcctcagtcctaatcacccaccttcctataccttggaaggctgctgaaccttgcctatgtcgttctcctaactcctccagacttcatctgaatgccactcagacacaaacaaaatcacacagtagcttcaagtagccctctccttcatctcagccctaagtgagctggccactgagtaataaaagaagctaccacatttatagggaggccagtctccaaatacaatggagtgggggtttgttcactgctgtgagtcagaaattgactgttataatagagaagagttttaaaaatgtaatactgtttatttaacttcaaaaacatttcagcattctaaacatacaaaaaaaataacagaacgttgcgaatcgtgtttaagtacaggaggttcttgaactttcattgatgcagtgactctttgctttgctgacaatgaagagttctatagtttgtttaaaaacaaacagtttaaaaactaccgcacttaaaaaaaaaaaatattctcatgccagctgacccccctttgtccacagctaagatggcagcagaatgctatgtcactatatacagaaacaagacaacctgaagctaaatggatgccccctgcagagtcaacaggtccagcctcacagtgcacgccctgagctacagcctctcccaaaaggcatcttccccacagcctcaacgccgagcaaggagcatcaagggtttgtctcggttgttttgttctttttacaaactatagatatatacagttgaaaactcaggatttctagccaataaccatagttaccaccaccttacaaataaaaagaaaatgccagaaacatctttaaatgccttgtcacaccaacagcaaagtgcacagagtgaggagaacacgagagtgccttttcattttaaaaatgtttggaaatatgtacaactttgatacagtttcagggtgctccagacacccatggccacttcatgtaaaccactgacaatttctagagcactttgagagactacaatatgatcgtgatcaaattttgtaattaaacctaatgagggcaacagacacttctcaaataagagatgtgtcaattacggcgctcccctactctaagtattcacaaggagacagataaacagtttctttattcatcctcctcctcctcctcctcctcttcttcctcctcctcttcttcatcttcctcttccacctttttccgggcaactttagcaggaccctttgcaccatcaaactttcctttcgacttatagtcagcaacatcctagaggaacagggacacatttcaaatgagtatgcggctgttttaacacaaagtagaaacatgcagtcctcatctcaggtaagaggacaggaattgaaatcaagtaagacagtgctgctatcatatatatctgaagtgtttccatatatgaatttggttcttagccattcgaatttaaaagttagtgggtgttcaagtgtccttcaagtcacattagtaggactatcaaatcctctgttaacatttttttttccttaaagagtaaggaaaatttttcaagcctgaagttgtccccaaaacaaagacctgtcaaaaaaaagcatgaacaccagcacccgtagctaccttgcagggggatgggcccttgagcgctatgctaagtactcagcccagcaaagctgccacatgccctgcaacctactgatagcagaaccactgcctgttcaccagtccaggcttccagccccaccttaccttctcatacttctccttcagctttgccgccttagtgatgtaaggctgcttttcactgtcatttaaattattccacatctcacccagcttttttgccacgtctccaatagagatgccggggtttgtggatttgatcttggggcggaattctgaacagaacaggaagaatccagaccttggaagaattacatacattacatgagaaaccacaaaaaatttgagttaaagttgaaatcccacattcctgagaagcatctccctcctaccactatgacttctccctaaagtgaagtaatctatgataccatatacaatgctacaaagttgtaggttctaaaatatataaggttagaaaaatatgtggtgcgcggctcacgcctgtaattccagcactttgggaggccgaggcaggcggatcacctgaggttgggagtttcagaccagcctgaccaacatggagaaaccccgtctctactaaaaatataaaaaaaattagccgggcatggtggtgcatgtctgtaatcccagctactcaggaggctgaggcaggagaatcacttgaacccaggaggtggaggttgcagtgagccaagatcacaccttgcactccagcctggtcaagagcgaaactccatctcaaatatgtatgcgtgtgtgtgtgtatgcatatataaaatatatgcgtatatatacgcgcatatatatatggtgctctgtgtgtgtgtatgcatatataatacatatgcgtatatatacgcgcatatatatatggtgctgtcccagtctttcaattactaggaaaggcataaagaacatacttcaaggaccctgacaaccaaaactagagtgcctccttcacaatggaaaggccaacagacaaccactgtgaatgtgcaagcacagcccacaaacacttcagccttaaccacagacaacgctggcactgcatcgtaaagcccaagtacagaatggtttgcagaggtattgccatcttttaagtatcttttaaaaaatatttcattttgaaatgaaatacaggacgaccaaaaaaccaaatcctccaagcagaagaaaaggtattaattgttatcttgaatcctatagtcacttacggtggccttttgggagcattaggatccttcttcttcttgcctcccttagctggtccataatccttcatttcccgatcatagcgcactttatctgcctttgccatttcatcaaatttagatttctctttcccggacatcgtctgcaaagaacaggactcgttaaatccctcgatgcagtgaacacatacctattcagtttcttgtgattaaactagcagttgctagaaccacttgcaaaagggggtaggtaaaggcctgaaacctgtgcagggccttaaaaaaataaaagcacacacacaaaattcttaagacaagcaaaaatgattctaagtaaaagtaaaagaggaagcaagcagctatctgggagaaaatctgaaggtaagtaaccccaaagtaagaaacccaactaagactagtttgaagggtaccaaagaaaaataccttccacctctcagagcacttcttggaaaattccgcaaaattgacagggacctctgggtttttcttcttatgttcttctctgcatgtctgcacaaagaaggcataagcggacatcttgccctttggtttcttggggtcacctttagccatcctgactgtgataaaagagaaacaaagaaatacaatgaggaaaagcaaggaggaattgacaagaagtacaagacgtaccaaaggcagagcaaaactaaaactacacttgctgttaggaagtccccttcccccaatgccggacaccagtggcagaaggcagagtaggaaagaaatcagcttcattgtcgcttgtcatttaacttttgaccagcacgaagcgcgctggtttgcgagttacttctcaaaagcgatcaagtgctccaaatggagccgacccaagtagggtactcagtgttacgtttacagaactgctatgttttggaaactacaatcacaaagtgggaagggtagagagaggacacatttggtgggggtgatagaagcttgaaatctatgacttaagactatctggtcatctgctaactgttaacacaattaaaaacaacaactcttaccactgctgaacacaagaccaaagcaggagaactatacgtaggggacatctgaaattgtcactattgttgatgtgttttggcttactaaaaaaacggctttacaacacgggagatctggaaagtgagcaggtacccccgtactattagttcaattcatcacttcgtcactatctaaagggggagggtgtataaaaagggctagtcgtgctcatctgtaacccagaatgcaggtccagccgagaacactttctccaaagtttccaaataaaaatgcagctgcggcatgtcatcgtccctgtcccaccccccagcttcccgccatcttttccttttcccacacccaaggtcatcatgtaaaactaaagagctccccttggcagcagccgcccaggaggctgcccaacagagacccgcagcggcggcccgggcggggcgggaccgggagcgggggagtcccggccggcagcaggcagcccgcctcggcccccgtgccgggtcaccgggacacccgtaattcaccttccattttgtcaaaagcctcctgatgaaagaaagtgcccctgaaatccgccgctgtcatccccgggggacgcgcggggccgggggcggcggcggtggcggtgcgcggggggtgtgcggccgggccggcggcagccgcggcactggtggcggcgtccgccgcgcctcggagtcccactcgctaaaatggctgatccgcgcgcggccggcgcgggcggcggcgacagcggcgaacaaagcggcccgggccccgccgccgccgcccgcccgtcggcccccaccccgccccgccccgccccgcccgggccgcccgggggctcgggggcccgggccggacctccccgccccccggcgcggggcgcactcctcgggataacaaaggcgcccgtgcagccatgacgctcggccgctccagggcccgcagcggcgcccccggccctccgagccgcccgccccgggccgcgggcgccggggccgaggccggagcccgccgggcgccccgccgaccgctccgcccgcctcccctgccctcgccggaggccagcgccgcgccagccatgttagcggcggcggcggcgccgggcgggcgggaggcgagaggggggcggccggcccgcgcccccccgggccaccgggcgctccgcgacggccatgttaacgcagagccagcggcgtagcctgcgggcccgcgcggcgccgggccaagcccgggagcgaagtttgcccgtgcggcggcccccggcgggcaccagccgcgcagcccccggcgggcaccggccgcccgttccccagcggagtccgtcgcgggccggggaactcccggcccccttcccgctgccgccgcccagcgcccacagcccgcagccgcccctctgctcgcccagccgccgcagccgcagctgcccaaacatctggcctcgggggccctgggttcccggctgcggcccctggggccgccacgggcgggcgtccgccgagggggccgacccccgaaagcggggagctcggggaacgcgttggaaaagttgaaacacctgaattgcttcttccttcccggccgcctagcaggagggaaggcggagggggcgggaagggaatggggagtagaggcagggggaggcggcggcagggcgcgctcacggcggcgcgggccggaaagttgtgcgggcgctgcggcggcggcggcggcggcggcggcggcggcggcggcggcggcggcggcggcgggagcgggcggtgcgagacgtacctgtattgttcgctagtctgggcagcgcagggcacgacgcgcggctcagcgctccccagcctcgcgctagctgcctccacgagagccgcctgattggccagcgggctctgccgtttaaaacagcctcctcgcctggccattggctgcgggcctcatgcatattaagcaggcgtggacgcccattgggcgcggctgctgggatcattcattcaaacagaacgacccgccggcgccggctacggaggccaaacagggaaagacctagtctcgcctgcccgccccgcccacctcgccagccccctcggggaacagaactgggatcgccaagggctttgaagaggtggccctgcgattcccggaggcctcggcctctggcgtgggaagatgaagtccagccccgctgcgctgccctctgctcccaccgcaccgcggccttggcgcccctggcctgcagtcagctcccctgcccggggaaacacccctgggcccaccacgaagggccgatggtagaccacctctacccggttcggccgcggcgccgcgacagaaacgcggcggcagctcgctcctcgatgcctggcggagggcagctgcttgctcgccaagacctcgggatttagtcctcggatctcgctgcctatccgaaagccacctgattccgcttctgcggatcgtgctcaactaggctctttccactaaatgccagaaggtctttatttgcgcccgaaattgcggaaccgacgggctaaaagaggaaaacaaaatttggcaagagcagagaatttgtgagaaattgtagttttgtgggcaaagaataacacttttcttcttaccctcttcactgtctcggttcaaggccctcattccctctgctctcctgacacaccctagagcaaagaattaaagcttcgggaatgaatgagtgaatgaatgaatgaatgggatttgacttgatctccactttgccattggctggtggtatggccttgagctagtcacttctttggggattcaggcaatgtttttcaaagtataggagccgcagtgtcacttctgtaagggatgttctgaaattcgtggggccggtgcctggatgactggcaggtgttgctggaattcaataagaggaaggaacggccggggatactaaatatcctacattgcataggacagtcccacgcaaggaagaaatactccacttcaaatgcaagtatcagccctatttggaaagaaagtatctgagggcccttgcctggaaagaatgaaagggtgagaaaaagagcagtttaaagattgacagttggagaaaataatgcaaaggaagagatgtcatgagtttggtttttcttttctttgaaaggccaagagatccagctatttatgagtcctatattcagaaataagccccaccagaacatgaattttccaaatgctgcttccagaaaccgtggctgagtttgaggtgtgcaaaggatctggcttcacagggcacctgcttcttcacccctacgccccctcttaccaactcctctgagcctcccagccaagcctgagcccctgaagctggtgctgttggctcccatcatcaaggttccaatccagatcaaaaggcaaagatagaggccaagcgcggtggctcatgcctgtaattccagtactttgggaggctgaggcaggcggatcacgagatcaggagttcaagaccagcctggccaatctgatgaagccccgtctctactaaaaatacaaaaaaattagccaggtgtggtgatgcatgcctgtaggaggctgaggcaggagaatcgctttaacctgggaggtggaggttgcagtgagccaagatcatgctactgcactccagcctgggcaacagagcaagactccgaaaaaaaaaaaaaaaaggcagagatagtgctgcttttgacaagagcaggcaggtattgtgtcactaacccaggtccccactacagactcaggagttcagagatcttaaggccacctcatccatccctctgtcctgttagaaccagcttagtggttgcctgccttctgcttgcatacctccactcatagggagcttaccatcttccttcatggcagttccttccatctccagccacctctgagccttaaggtcaacatctccacacagggtaatccctcacccttcagatagttcatggcaggccaggccttttctccagacagacagcccctccctgctccttctacaagcagtttcccagggcctgacctgcccaagccactccctcttcccctgtctccacaaggcctagaggggagcagggtttccacaagtgatctgaccaatacctcgcctctgccagagcaccctagcctctcaaggttgccaggcctttctagaccagagattcaagttggggtccagctactgcccagcaactgcccacagtggcaagtgacacggcacagttggcaggcaccttggtgggggaaccagggtggtgggcccttggatggatgacaagggtcacacaagcccatgccaactcacaagcagcacatgtatacacgtactcacgtatgggcacacccagggcattcccagaggcagcagcttcaagggcaaaccagagaaataagagcatctcccaacccaaactggcccccagttgccaccctcaagatccatgcttccctgccccactgccccaaccctgcccattgaccatctatttctccccacatacttcgaatgatgaaaggattgcgcttacgcgcaggaagtatttccatcctttgcataggaaatatttcgatctctgctctcaagaaagctacctcttatatggagctgaagcacttggcctgaagctgaactacaaactggtcatcgtcagaacatgaactcacagaacatgactatgacatcactgagtgacagagatccaaagatggctccctgctcctccccatccccccagccacccacctaccaatggaggctcctcacagccagattttctccttaacacctgcccgtgtgcggcgacatgcctgagcaaggcctgtggcccagtgggctcctgccttagcagaaactttcatgtatatgtattgcatgtctactaatcagtaacagaagggagatgagatggagtggggagtaaggctggaaggaagggacaagatagaggctttgggctctgtcactgatttcctggtatgccttttcacatgtcacctgagggctccgagcctcagtgtcctctatcaaaggtgattccacccgcctcatccacccagaccactgccagtcttggtggtgagggagactgagtgaagacggtctgcttgtcaccagtcaaaggccaaccaggagaggcctaaagactagtttggaaggtgaaaaaaagaaagaaaaggtgacagaaagccagggatgcctgggcacaccctagactcagggagcccaaggcaggctgccttctctgcagcaaagctcaatgcccgttagcttgaggatacctccagcagcagcacccaggtcagcgtgcaagggcttgagggaatgaaggatactctaggcctctgcccgggccctacctggaaacaggcaaagcccatccacacaggagaacctcaaaccagaatcccttaagctgcttggctgcctagagaagttacgaaaacattaaataagaaatgggatgaagtgtggcaaatgctatttaaagaggttttcagttcctgtcagttcaaggcccctaaaagactaaggggaatcctcatcgttcaacaaaaatgaaaccctggtcccctggcccactgcctacacactccacccaccctcccacagttcccaaagtcttcatttgagtaccttgggccaacccagcctccttttaagaatcatgcctggccgggtgcggtggctcacgcctgtaatcccagcactttgggaggccatggtgggcagatcacctgaggtcaggagttcaagaccagcctggccaacaaggtgaaatcccatctctactaaaaatacaaaaattagcctggtgtggtggcacctgcctgtaatcccagctactcaggaggctcaggggggagaatcgcttgaacctgagaggctgaggttgcagtgagcagagatggcgccactgcactccagcctgggtgacagtgtgagactccgtctcaaaaaaaagaaaaagaaaaaaaaaaagaatcatgcctgtaggccaaatgtggtggctcacgcctgtaatctcagcacttggggaggccaaggtgggtggatcacctgaggtcaggagttcgagaccagcctggccaacatggcgaaaccccatctctactaaaaatacaaaaattagctgggcgtggtgatgggcacctgtaatcccggctactcaggaggctgaggcagagaattgcttgaacccaggatgcacaggttgcagtgagccaagatcgtaccactgaactccagcttgggtgacagagtgagactctgtctcaggggaaaaaaaaaaaaaaaaaaaaaggaatcacgcctgtaaacccagcactttgggaggccaaggcaggaggatcacctgaggctaggagtttgagaccagcctgggcaacatagtgagacccccatctaaaaaaatcaatggaagtgtagacagagtggatttggggggtaggggtggaatgggattgttgaacaaaatatattaagggaagccaggtgtagtggcacccacttgtagtcccagctacttgagaggctgagaggctgaagtgggaagactggttgagcccaggagctcgagaccagcctgggcaacaaggtgagatctcatctcaaatatatatatatatatgaaccagatgcagtggcttacatctgtaatcccagcagtttgggaggctgaagcgggaggatcacttgaggcaaggagttccagaccagcctggtcaatatagcgagaccttgtctcaaaacaaagaaataggctggacgaggtggctcatgcctgtaatctcagcactttgggaggccgaggtggggaggctgaagcacgagaattgcttgaacccgggaggcagaggttgcagtgagccgagatcgtgccactgcactccaacctggagtgagaccctgtatccaaaaacaaacaagcaaaacaaaacaacaacagcaacaacaaagccaaaaaaataaaataaaatcttatatataagtattaagggaacttgctgtgaagaccctacaatgaaacaagatctttcaatatggcacctaggaacctttgtaaatatggagtccttataagtgcagatcttcagggatagggagtcttgactggcttccaggccttctcagggcccctgccgcacaccgcttagcctcctgtgaactacttcaccacgaggtgcctcccctcacccctccctgttaccagccccgggtcccctcccctcaccgtctgctctttggtgggaattgcattccaactctacttgtttttcccatagaggggaaaaccttctcagaggtggttctctattagaatggatctgcagagctgcaccactgggaagactcttccaggccctccaacccagcctcctcgtggcacagagggcccaacgcctggagatttgctgaagtccccacatgggtcagtggctgagccagggcgggaactctggtctcttggcctttactaggtgccacacttggtagctctcgatagcttagctccactgtgggtgccgcggcctttggtgagctggcgagagcagccagcacccttgagaagaggttttctggttccaaacagaagccgagagagacccgcggggaacccggtggctgaagctggcctccaccacctctcctgcccacatcgcacagttcaggccgcgggtacctagagcctcgacggcgcctcgggccccaagcgacgtgggtgtctgcattttctttctttctttctttctttctttctttctttctttctttctttctttctttctttctttctttctttctttccttccttccttccttccttccttccttccttctttctttctttctttctctctttctttctttccttctctctgtctctctctttctttctctctctctttctttctttctttccttctctctgtctctctctttctttcttttttgagacggagtctcgctctgtcacccaggctggagtgcagtggcccaatctcggctcactgcaagctccccctcccgggttcacgccattctcctgcctcagcctcccgactagctgagactacagaagccggccaccacgcctggctaattttttgtatttttattagagacggggtttcgccgtgttagccaggatggtctcaatctcctgacctcgtgatccgcccgcctcggcctcccaaagtgctgggattaccgacgtgagccaccgcgaccggcctctttctttctttctttgagacggagtttcgcttctgtcgtctaagctggagttcaagggcgctatcttggctcactgcagcctctgcctcctgggttcaagcgattctccagcctcagcctcccgagtagatgggattacaggcgcccgccaccacggcccgctaattttttttttttttttgagacggagtcttgctctgtcgcccaggctggagtgcagtggtgcgatctcggctcactgcaacctccgcctcctgaattcaagcaattctcctgcctcagcctcccgggtagccaccgcgcccggctaatttttgtatttttagtagagacggggtttcaccatgttggccaggctggtcttgaactcctggcctcgtgatctgcccgccttggcctctcaaagtgctgggattacaggcttgagccaccgcgcccggcctaatttttgtatttttagtagagacggagtttcaccatgttggccaggctggtctcgaactcctgacctcaggtgatccacccacctcggcctcctaaagtgttgggattacagacgtgagccacggcgcccgaccgggaccgggaccgggcgtctgcatttcaccagatggctgcgcccgttgcccctcccgaattccctcaccccctccccaccagaccccggaggctgccggggacggtgggaaaggagccaccggggcggctccctcccacagcactgctcttgcccagggctgggacaaggaagagaaaggagcgcagaagccagggctgttcagcacgacacaggcctcttcagcagcaccagcgccaccgcgtccctgctctgggttcctttcatattgaatgaaaagcgggaagtgggtcagtgaccaaaggatttcctactttttactctccacgccggcgccttgtgggaatacaatcctaatctacaaaagcccatcaagggccagtgacgtgccaggccggccgggtcctgtggggaagatggagatgaaactgaagggcccttgaccttctaggcaccggtctccttcagaggaggggaagggagcagaagagaggggactctccaatgggatagctcccaccagccaccacattaccgaacagccctgccttgtcccgccttgaagtcttcaccatgctgctgggttacccattctagattctcacctccaagccccatcccatccagaaggcctgcacacgcagcagactgtagtccccaccctccacccacaccaagtttccgtctggctagtgactgaggcccttctgtgtctaccccgtgtaatgtgtaatgtaaaggtacaagctgtttctctttacctgaactgaaaggattcctgcagtggggagaggaggagccactctctaaatgggattgcagttgccattttaaaaatcatttttattattatttatttatttttgagacagagtcttgctcttgttgcccaggctggagtgcaatggcagcaagctttgctcaccgtaacctccgcctcccgggttcaagcgattctcctgtctcagcctcccaagtagctgagattacagacatgtgccaccacacttggctaatttttatattttcagtagaggcagggtttctccacattggccaggctggtctcaaactcctgacctcaagtgatccgcctgcctcggcctccccaagtggtgggattacaggcatgagccaccgcacccagcctttttttttttttttttgagacggagtttcactcttgttgcccaggctggagtgcaatggtgtgatcttggctcacctcaacctcttgcttcctgggttcaagcgattctcctgcctcagcctcctgggtagctgggactacaggcgcctgccaccacacccagttaatttcgtatttttcagagagatggggtttctccatgttggtcaggctagtctctggacctcaggtgatctgcccacctcggcctcccaaagtgctgggattacaggcgtgaaccaccatgcctggcctgcagttgccatttttaattctttttttttttttgagatggagtctcacgctgtcgcccaggctggagtgcagtgtcgcgatcttggctcactgcaacctccacctcccgggttcaagcaattctgcctcagcctcctgagtagctgagattacaggcgcccgccaccacgcctggctaatttttttgtttgtttgtttttgtttttttagtagagatgggattttaccatgtttgtcaggctggtctcaaactcctaaccttgtgatccacaacagttgccgtttttaaaatgctgctcattcctcattccctctttctgggcctgattccttttttttttttttttttttttttcttttttggagaaggagtctcactctgtctcctaggctggagtgcaatggcatgatctcattcactgtaacctccgcctcctgggttcaagcgattctcctgcctcagcctcccgagtagctgggattacaggcatccgccaccacaccctgataatttttgtatttttagtagggatggggtttcaccttgttggtcaggctggtctggaactcctgacctcaggtgatccaccacctcggcctcccaaagtgctgggattacaggcgtgagccactgcaccccacctgggcctgattcttatcattaaaaggggagcaggagctgctctctggggtctcttacagcatcagcattctttttttttttttttttttgagatggagtctggctctgtcacccaggatagagtgcagtggtgcgatcttggctcactgcaacctccacctcccaggttcaagcaattctcctgcctcagcctcctgagtagctgggattacaggcacccaccaccacactgggattttgtatttttagtagagtcggggtttcaccatgttggccaggctggtctcgaactcctgacctcaggtgatccacccgcctcggcctcccaaagtgctgggattacaggtgtgagacaccgcgcccagcgcccggctgcatcaacattcttgacattgctggtggggcttcacaaaggtacccccaaggcaacacgccagttctgccgccacccacctcccccctcccccgccaccaaaataaaccccacaaacagcaaacaagtctgaaaggtggccttgcaaaggtcctttatgtgtgactctaaaaagtatggcatttgtcgtgactatgagtgtcagtccctcttccccaatttcactctgccctggacacagtagtcagaccggtcctgctaaatcagaccttgttatgaaggaagtccggagtggacccggggcacagctatcggatgaaatgcagatgccttgccctggggcccgaggcactctggggacatagaggcagggctcaggacactttgggggctccccacctcctcaggggaagcccccgtcttcccaatgggtttgcacaggttgctctccccccaaccccctcagcaaacacacgtgattctatctctcctcaccctgttgtcaacctcgctcaggaacagccacctcaggaccttgctaccttgctgcttgctctgccctctacctgggacactctcccacacatctgccaggatcctgccctcacctcccttccatctttgctcaaatgtgtcaccttccctgagcaacctattgcgaatcaaaatccccagctccacattgcctgcctctcttttccttgcttagtttttccacatccaattcatgcccactgtggtacagcagcttcacactggcttcccaggagacagtgagcaccatgaggccaaggacctcagtctgctgttttccactgtgtccctctatgtggcgcagaacaggcattccattacaatttgttgaacaagcgaatgcgttttccattgaccttgaccactcctttaccatgttctaagtaggccccaaggcaagaggacttccatagattcccaagggagactccccaccctcaagaaacttgcaatggagggagggcagacacacctgcaatggagtgtgcataaaataaatgccaatgccaaatagagggacaagcaggcagagccagcaaaggctgagaggaaggctttatgtctgattgtgggtggcatagggtctggaaggctttatgaacaaaagaggtaattttgaaatggatgcagagagttagtgagttttccatgggcaataaacgagccaattaccccaggctgtgggcaggtttactgtgaactggtgggaggacccgaaggctgggatgtcaggggaggggtgcagtgagagctgctctggggacatagaggtggggcacagcctggacagaccaaggctgttcatggcagaggttgtcatccactgcttctcaccagcaggcaatgggaagccatgacaggatttttctttgagagagacaggatctcaggctgggcgcggtggttcatgcctgtaatcccagcactttgggcggcagaggtgggtggatcacttgaggtcaggagttggagaccagcctggccaacatggtaaaaccctgtctctaccaaaaatacaaaaattagttgggtgtggtggcgtgcgcctataatcccaagtactcaggaggctgaggcatgagaatcacttgaacctgggaggcacaggtcgcagtgagccgagatcacatcactgcactccagcctgggtgacagagcaagactccatctcaaaaataaataaatacatcaacaaataaaaataataaggaggtggccaggcgccgtggctcatgcctgtaatcccagcactttgggaggccgaggagggcggatcacctgaggttgggagttcaagaccagcctgaccaacatggagaaactgtccctactaaaaatacaaaaattagccaggcatggtggtgcatgcctataatcccagctactcgggaggctgaggtaggagaatcacttgaacccgggagatggaggttgtagtgagcggagatcgcgtcattgcactccagcctgggcaacaagagcgaaactccatctcaaaataataataataaagagacaggatatcgctgtgttgcccagcctgcagtgcagtggtatgatcatagttcactgcagcctccaacttccaggctcaagagatcctcctgcctcagcctcctgcatagctgggaccacaggtaggcccggcatttttttttttttaatcagctgaatttaagactcttcttttttttaactttgaagttcaggggtacatgtgcagatttgttacataggtaaacttgggtcatgagggtttgttgtacagattatttcatcactgaggaattaagcctagtacccattacttatttttcctgtttctctccctcctcctgctctccacccttcagtaggccccagtgtgtgctgttttccgctttgtgtccatgtgttctcatcatttagctcccacttacatgtgagaacctgtggaatttgttttttggttcttgtgttagtttgctaaggacaagggcctccagctccatctatgtccccgcaaaggacatgatctcattcttttctgtggctgcatagtattccattatgtatatgtaccacattttctttttcttttcttttctttttttttttgagatggagtcttgctctgtcgtccaggctggagtgcagtggcgagttctcggctcgctgcaagctccacctcccaggttcatgccattctcctgcctcagcctcccgagtagctgggactataggcgcccatcaccatgcccggctaattttttgtatttttagtagagacggggtttcaccgtgttagccaggatggtctcgatctcctgacctcgtgatctgcccacctcggcctcccgaagtgctgggattacaggcatgagccaccgcgctaggcccatgacgggattttgagcaaggatatgacccagtccagactctatttgagaaagccctccctgctgctgtaggggatgggccagaggcagagagatcctttaggagaggttgcaggtcaaagctggtgtgggcttagatttgggatattggtagtaagggtgggaaaaagtaactgaatttgtgccccacctacctcccagccaccctccgaccaatagcaagcgtgacctttcttcatattgtaattctgagcatcatgttagttttccaatggcttctcctctcattgcagtaaggaccccagacacggcccttcctgtctctgtagcctcttgttcacttttttttttttttttgagacagagtctcgctctgcctcccaggctggagtgcagtggcctgatctcggctcactgcaacctccacctcccgggttcaagccattctcctgccttagcctccggagtagctaggattacaggtgcacgccaccatgcccgggtaatttttgtacttttttaaagtagagatggggtttcaccatgttgttcaggctggtctcgaactcctgacctcgtaatccgcccacctctgcctcccaaagtgctgggattacaggcgtaagccaccgtgcctggccctttttttttgctttattttgtttttgttttagagacagagtcttgctgtgtcgaccaggctgcagtgcagtggtgccatctcggctcactgcaacctctgcctcctgggttcaagcgattctcctgcctaagcttcccaagtagctgggaagctcaggcaggcgccaccatgcccagctaatttttgtattttttgtaaagacggggtttcgccatgttggccaggctggtctccaactgctgacctcaggtgatccacccacctcggcctcccaaagtgctgggattacaggcgtgagcctctgcgcgtggcctctttttcactcttttttttttttttttttttttgagactgagtctcactctgtctccaggctggagtgcagtggcacgatctcggctcactgcaacctccacctcctgggttcaaatgattctcccacctcagcctccggattagctggaattacaggcgcgcgccaccatgcccggctaatttttgtatttttagtagagacggggtttcaccatgttggccaggatggccttgatctcttgacctcgtggtctgcccacctcggcctcccaaagtgctgggattacaggagtgagccaccgggcctggcctctttttcactcttaataccaactccgccttctctcctttccctcatcgggggcgcatacccgctgtttccactgcctcaggccctctccctcctctctcatgcctaaacaagtaccacccaccctccagacctcagcccagtccccaacaccttccctgggagactccccgacttctggtccgcattttcctttctccgtctggtcctttgtggtgcttctcacagccacagccactgtctgggtgattacttgactgtctcacgtgggcttccttgcaactagcacagggcctggggcccaggagacaccaggaaacatctgctgaatgaagacctgagcaagtaaaggaaagcctgtgttcttgggtgctaggtgtggagggcacaccctctcagaaggaagcaagcactctgtgggctgtttcagccaagcaaggaagaggacctggctgaggggagggggaatgaggaaaagagaggacttaattcagtcaagcagtggattcgctgcatatccacctccttcctagagggaggcccaagggcactcccctttggctgccacagggcccagctggggacctggagggaggtgggttccgggaacaccctcctctttatttctaagcactagaatcctgtgaccgatatgcagtgctggccagggctttgacttgcaaagagagcactgaagtccgaagagcactgcctgtaggtcaggcgggcgtggcgaggaaaagcaggagctggctccgcatcctgtcacttaccagctatgtgactttggcaagtgacttcacctatctccaccccagtatcttcttcttcttcttcttcttcttattattattattactattattattttgagatggagtctcgctctgtcgaccaggctggagtgcagtggcatgatcttggctcactgcaacctccacctcccgggttccagctattctcctgcctcagcctcccgagtagctggtactacaggtgtgtgccaccacgcccggctaatttttgtatttttagtagagacagggtttcaccatgttggccaggctggtctcgaactcctgacctcaagtgatccacccatctcagcctcccaaagtgctgggattacaggcatgagccaccgcgcctggctagtttctccattttcacaatgagccttgtaatagtacctaccttataaatgctggggattaaacaaattaatacacatgaagtatttagagcaatgcttggcacaaaaataagtgcccaagaagggttcactgttctaacagagtcacctttgatttcactcttaattcttcagacagtgcagaagagcagtcactgaaggaaaatccaaacctcggtagcacaggctttgaactgtgtttttctacaaccaagagagttgcctttgctgggaattgcatctgtctgtgacctgagctgtagaatcaaggcatcatggctgggtgcatctgaacacacacacccacacccacgctagccctacttcaacaaatatttatgctgcaacacctggtggggtgccggtcctgtgtatcttggtctgtgccagaagcggtgaggggcacttgggccatcgcgctgccagggtccggcagcagctcctccagagcaaggactgagttccgttcacctctcaatggctccacctccacagtgccccgcccaaggcctggcacaaagtacaagctgagtgagtgtttgctgtgtgggagagttttgtctccagcagaacggacctgcatttgggaagtggacaggtgagtgtcacccgcatccttgccttctggctggacaggtgatattgctccatgaagtatcgggcaaacagctgtgttgccaaaaccaaaccaagaaaggtacagtagagggactagtaacccaggagctataggatgtggctctgctctctgctcttctacagcttcaagaggctttggcaaattcctgagcttcactggtcctcagtttcccgttctgtacagtcagcgagtcttactagatactggatcatctccagggctctttcttgtactaatagccactggagcataagctccttaaaagagggcagaaattttgttttgttttggtttggttttcctcctaatgtttcccagatgccttgaagaaagtccattgtatatgcccagtgaatagttgctgaatgaatggatgaagacgctgcgattctaaggtcttgtagtgaactggaaaaggtatggtttgtttttgtttcggggtttttggattttttgagatgaggtctcactctctcacccaggctgaaagtgtagtagcgtgatcgcagctcaccgcaatctcaaactcctgggcccaagtgatcttcctacctcagtatctgggactacaggggcgtgccaccacacctagctaatttgaaaaggtatgtttgtattcataaacagatcccctttgtttggtaatcatcttttctagtgattctggacagcttggtgtcagattcactgtgcctctcagatcagcctgcctcaagatgtttcaagtaaaaacctttcttttaaacatgatttgtctagactatcatctcaactttccatttacttttggttatgtttttacctggtctgcatgattcactggttatcagagaaaagtacaatcagataaaatgataagagtaaggaactgtaaacagaaacagcaaatggcccaattcaaagcggagaacatgatgtgaatggtaatgatgccaccttgcattttgttccttaacagtttgcctggtgcttgcgtatctgctgtctgacttgcaccccctaatgatcacgtgggatgttttggcatattttggaaaaactgcaacccagaggaggcaactgttttgtccaagtataccaggccatctgtgagaaaactggaactctgcctctctgtctttttatttttattcttttgagacaggatctcactcttttgctcaggcaggagtgcagtggtgcaatcatagctcacagcagcctcgagctcctgagttccagtgatcctcccctctcagtctttgtaacaggctttactgcctggttgttttcagtgagcaaacaaacaaggagagggttagatgcacagagggcatctgtttcccgttctgtacagtccggtgtcagtgaccattcaggactcttctgcctgcagacagccagagaaaagggcagcaaaggtgaaagggcctgagggcaattgctgaagtcatcaattacgtgacctgccactacctcacctcagtgtgtcccaaactaaattccccaacctcggccccggcccccatatccgtgcttagagaatggcaccaccatccccccagcgtcccgcctggctcttccctcgccctcacttcccgtatccaggctaccagcaaatcctaaacatgtccgaatccagctgctcctccccacctctcactaccaagcagagatcgtctatctgtctctcccttaactcgtctccctgctcagccgtctcctatcatctggagggaactttttactttttaaacatttttattatttttaatttttttgtagtaacagggtatccctttgctgctcagtttggcctcaaatcgcctggcttcaagcaatccacccaccttggcctcccaaagcgctgagattacagagatgagccttcacacctggctgaatttttataaatacacatttttctgtcttgtttaaaattctggcccggcacagtgactcacgcctgtaatcccagcactttgggaggctgaggcgggtggatcacctgaggtcaggagttcgagaccagcctggccaacatggtgaaaccctgtctctactaaaaatacaaaaattagccaggtgtggtggccggcgcttgtagtctcagctacttgggaggctgaggcaagagaatcacttgaacccaggaggcagaggttgcagtgagctgagatcacaccattgcactccagcatgggcaacaagagtgaaactccatctcaaaaaataaaataaaacccttcatgactcttcattaccttgagagaaagccacagaaagacccttcaaggcagggcacagtggctcatgcctgtaatcccagcattaggaggctaaggtgagatgattgcttgagcccaggagttcaaggccagcctgggcaacatggcaaaaccccatctccacaaaaaataaaataattagctaagtgcggtggtacgtgcttatagtcctggctccttggaggctgaggcaggaggatcacttgagcctggaagattaaggctgcagtgagctataattgcaccactgcactccagccagggcaacagagtagagtgagacattgtctcagaaaaaaaaaaaaaaaaaaaacctccaagattcagttccagccaggttcctgccaccaacctcccccacccaccaactgcacacacatttcatgatccctctcagcacttctctgtctccaagcactttgctcacactattcctgaggaccagaatgccctttctcctttatctctatggagattctgcttactcttcaatctcaatcagcaccttcctcctgaggcctccttgatgccaatgcctgccttagattgaaatgagccagctcagcaacacagcgcttgattggcagctctgcaagagcccagagctgagggtgggctgggcgttccaggtggtttggtacctgccgggctcttccaccacacctggtgcacccccagggtgggaaccacctcccagagctctctagaccacccattgccctgcagggtttgttccttactaggagctcccagtaaaattggaacagaattaaattagcttgccggtgttcagggatgaagggcagcatcatttggtaataagtgcagcaacctgaaagctctgagggaaaaaaagggtgaagagagagaaagaaagatccacagtggccttgctgttgctgctgccactgctgcggtggcctctgggaagtgtctccctccagctttctgcctttaatcctaagaattgggtgatgctggcccgggcgcggtggttcacgcctgtaattccagcactttgggagggcgaggtgggcagatcacgaggtcaggagatcgaaaccatcctggccaacttggtgaagccccatctctattaaaaatacaaaaattagctaggcgtggtggcacgcgcctgtagtcccagctactcaggaggctgaggcaccagaattgcttgaacccgggaggtggaggttgtagggagccgagattgcaccactgcactctggcctggtgacagagcgagactccatctcaaaaaaaaaaaaaaaggaactgggtgatgctaatgatgatgataagctaaggattcgacagaaatccggcttctggaacacttgattgggggatctggagggaagtgagtaccaaatcaggcattgccctctctcctttagatcttgctccactaatgtgacacctgattatgtgataagctcagcatatgttgctacttaatttaaatatttatggttggttttcaaatcagctcttaacttgccagagtgttgagactctatgaatcatacaactttccaagtggaaggaccattagcatctaatgtaaacttttccttttctagatggggaactgagtcccagggagggccaggagctggctcaaggtcacatgaatgttagtggcagagctgggcctagaacccggggctcctgcctcatggcccagggctctgtccactgcaccacactgcccgcctctttcaccaaaatgaaaactagaaaactttggagcaaactccaaactcctggatgccaatgcctgccttagattgaaatgagccagcacagcaacacagcgtttgattggcaagcatgctggtgtgttagttgtgagctgtgttggttgtgagctatgtttatacagcatcaggggaaaaggaggcacatcattctctaggaaaggaaataaagaaagtggatgtagatggcgagatagttcacttaagcctgagagaagtgtaagtgatctcccaccatctcacctgtcccctaccccagcaaagccactccatagagttggtgccattccggttgatctgagtgtatgaactggcctttggaatataccactctgcccctccctccaaatggcgagggtggggacagacttctcaggccctgctgacggatcttgttttacccaagcctctatttttgttttgttttggagagatggggtctcactttgttgtccaggctggtctccaactcctaggctcaagcgatcctcccacctcaacctcccaaagttctgggattatgggtgtgaaccacagcacctggcttcccaaacctcttgatcaatttgtatccatatgagtaccccaccagctgcacttcacctccagaaactcagaatggtacaacagccttgcagaatgagactttgagcaggctggaatataactgagtccaggtgaggatacatcctggtgggggtatgtcctggtgggcatatagtcttgctgtcatgttgtcttgagagctttgaatacaaaattgtactgcgggcatgtggtgggtgcagaggtcaaaagcacaggctcccagcctgggcaacgtagtgagatcctgcctctgccaaagatgaaaaaattagctgggtgtggtggtgcatgctgtagctgtagttccagctactcaggaggctgaggtgggaggattatttgagcccaacaggtcaaagctgcagtgaggcatgattacgccattgcactccagcctgggcaacagggcagagaccctgtcaaaaaaacaaaaataaataaaaaataaataaaaacacacaggctttggagtcagagagacctgggtttatgcctcaactctgtctgttcctagctgagcacccttgggctggttgctgaccctctctgtatctcagtttcctcactgataaaatgggtctgataatacccacttcataggattattgtgacaattgtagggaaaaagtatggagtgcactgtatcaaggtccaggcacatatggaagcattcaataaatgtgattgtcctagaaaggtgaaataacgggcaatcttttttttttagacggagtctcgctctgttgcccaggctggagtgctcgatctcggctcactgcaacctccacctcccaggttcaagcgattcttctgccttagcctcctgagtaggtgggactagaggcacctgccaccacgcccagccaattttttgtatttttagtagagacggggtttcactatgttggccaggctggtctcaaactcctgacctcgtgatccacccgcctcggccttgcaaagtgctgggattacaggcatgagccactgcgcctggcccaacaggtgatcttttattctatttcttttttctttcttttctttttttttttttttttggaggtagagtatcttaaaaaattctacttctttatactatttgatacgaatcaggaattacttttatgaccagaaaaaatacagtataaagggagaaaaaaacctatgcaacaaaacatttttcaaatagatcctagaaggtacaggtacctgtgaggtaattctgaggatctgggagtcctcacatatgtcatccccactatcagggggtggacaggatgttgccaggtcacagggaaaaggaaagagcttaagctgggaagcaggtaccaaaacctgtggtcctaacttgtgccctggggccagcatttggtgtttctctttatattgccctgtggttatgcatggtgcacgctatcttctggcagcaaagccaaccaaagcgaaacgaaaaccaactcatgattttcactagacttgttgttgttgttgttgttgagacagggtctcgctctgttgcccagagtggagtgtggtggtgcgatctccgctcactgcaacctccacctaggttcaagcaattctcgtgcctcagcttcccaagtagctgggattacaggtgcgtaccaccatgcccggctaacttttgtatttttagtagagacaggtttttgccatgttggccaggctggtctcaaacttctggcctcaagtgatctgttcgcctcagtcacccaaagtgctgggattacagggatgaactgctgtgcccagcctccactacactttagcagaaataaaaacatctcagctcaggcacagctctcaaatctacagtctttcatgatgaaggagtcaagtttgggttccctattcctgagttaaataaaaagtaatgctgtacttttcggttttgttttttagttttttgtttgtttgtttgttttttggtttttttgtttgtttgtttgtttttagacagagtctcactctgttgtccaggctggagtgcagtggtgtgatctcggctcactgcgacctccgcctcccaggtttgagcaattctctgcctcagcctcccgagtacctgggattaccagcacctgccaccacgcccagctaatttttttgtttttagtggagacaggggtttcaccatgttggccaggctggtcttgaactcctgacctcatgatccacccaccttgacctcccaaagtgctgggattataagcgtgagctaccgtacccggtcttcttttaggttctttaagacataagaatgtatagaaagctactgagataggaattatttgggggaaaggggatcttagaacctgatttttgaaagggcctgtggtaggctacaaactggtcccccagtagagatccacattctaatcaccaaaacctgtaagtgttaacttacttgttttgtttcctctctctcttattacccacaataatgttaatttaaatggcaaaaataaataaataaataaaatgaggtttatgtacatgtgatcatgtttaggattttgagatggggacactattctggattatctgggtaggtcctacatgcaaccacgtatatccttatgagggaggcagagaaagatttgatgcacagatgagaaggtgatgtgaagctggagcagagacagatttgaagatgctggtcttaaagatcagagtgatgcatccttaagccaagaaatgcaggaagttgccagaagctggaagagacaaggaatggattctccctttgagcttccagaggaaacagggccctgccagcaccttggtttcaacccagagatactgattttagacttccggcctccagaaccgtgaaaggctaaatattcctgttgttcaaagccccctagtttgtagtactttgttatggcagcccaggaaactaacacagagtccttagagttcatctagtccaaggtatgggctttttcctttgtttgtttgtttgtttgtttttgagacaggctctccctctgttgcccaggctgaagtacagtgatgcaatcatggctcactgcagcctcgacctcccaggctgaagcaatcctcccacctcagcctcccaagtagctgggaccacagttgggcaccaccgtgcccagctaattttgttttgtttttagtaaagacagggtcccagtatgctacccaggctggtctcaaactcctgggctcaagcaatcctcctcggcctcccaaagtgttgggattacaggcatgaaccaccatgctcagtctctaatgattttcttagcaccgaaatcaattacttttcaaatgaaatcattgcctatagaaacaacagatgcaaacagaggagtgatgattgaaaaaggaggtccagatccccacctgctaaatcccctcaatggtggctcctgaagcacctcccaggaccttccaccaacagagtgtgaaaacacttgtctagtttcaacctcattgtacagatgaataacttgagcctctaggggctgagtgattggctgaaggcctcccttagcaggcagcaaggaacacttatggggaggaaaacaaggcaagttactcctgcctgctctctcatcttcccttgcctggtttggccaaatccctgtctcccaagcaaacaactaagaatacgttgctgtctctatatgaattttgtttttagcactagttccagttttgaacagggactgccagctgtgtcaaatatggcgaggctcaaatgaagtatttgctcatgaagagcacagacctggagcaggctgttaaggcatcttcggagatgaaaaattactgcctgattcctcacctgtatttgcaaattgagtctcgtgggtatgactgcaacagtgggtgtgaggaggtgggcaggaatgaatagcaaagttaaccagctgtcggtgaacccggaaatatgaatccctaagtggatcaagaagagcccagataagagcacaggtgaatgccacatcacatttttcttgttgttgttagattttaaaacatttaaggtcagttctgctaaaaggcctttgtggaggataaagaaaaggttataataaaatattactccccttttccctctggccttggtactaacagacaagacattaaaagtcaggttctctttccttcccaagcatagtcaagataggatggcattttctccttccttccttccttccttccttccttccttccttccttcctttctttttttgatggagtctcactctgtcgcccaggctggagtgcagtggcgtgatctcggctcactgcaacctccacctcccgggttcaaaccattctcgtgcctcagccttccgggtagctgggattacaggcgtgtgccaccatgcctggctaatttttgtatttttagtggagatggggtttcactatgttggccaggctggtcttgaactcctgacctcaaataatcctcccgccttggcctcccaaagtgctggaattacagacgtgagccaccgtacatggtaggacggcattttcaaagggaactttacaaggaactatgaggaacccaatggggcattaaacaaacaagatccaaaccctctccaggggttaaaaatgactgaccgtttaccaagctgattccgaattcgcgaccgtttagatgcctatttccagggccactggcctcatccctgctacttgaccaagtggcactgagagaagtattgcatccggaaagaggaaggccagggtgtgttccaagaatgaatcaaataatgggaagcctaactaagaccagtggatgagccaacaatgccagctggctgctcaaggctgctgggagggaacactcagtgcagcagatggaacacaactggcaggcaacagcaaatggcattagtgtggcttcctttgttccttggtgttgctagggaggatgtcctctctccattctgcaggccacatggttccaccctccccaaacagtagggaaggatgaaggtccctagctgccacccactgctgctccaactgaaggaacaatgtgtctttttaatttatttattatttatttatttatatttgtttatttattttttgagacaggcgtggctctgtcgcccacactggagtgcagtggcaccatcatggctcactgtagcctcgacctcccaggttcaagagatcctcccacctcagcctcctgggtagctgggacttcaggcatgtattgccatgcccggattttttttttttttttccccgagacggagtcttgctctgtcgcctaggctggagtgcaatggcacgatctctgctcactgcaacctccgcctcccaggttcaagcaattctcctgtctcagcctctggagtagctgggactatagtcgcgctccaccacgcccagctaattttgagtagaaatgaggtttcgcgatcttgaccaggctggtctcgaactcctgacctcaggtgatccacctgcgtcaccctcccaaagtgctgggattacaggtgtgagccaccacgcccggtctatgcccagataattaattttttttttttttttttgtagagacaagttgttacctgctgtgttgcccaggctgggggaccatgtgtctttatgcaaaacacaccaggcacttgcagaggtggccagctttccccagaaaggacctctcacagactttttctttccatttgtttgtttgtttgtttgtttgtttggctttcaggtaatgttgcttctcaattcatgatctcaccatcattggtctgtgagattcttctctggctgaatcaatctatccatctctccagtctttttaattactgttttccactctaatgctcctcccctcagtggcaaccactcaagtgtgtgctctgtcaaactgtgtagaggggtgtgtgtgtgtgtgtgtgtgtgtgtgtgtgtgtgtgtgttttcagtaaacataagtggtagtggcctggagagtgtgttcagtctcttactgggtgcttttccactgagccctgtgtgtgttaactgtccatgctgctgtgtgttcctgagttgcttgtaaccactcatttgcttctatttttccccagtggtggacacctggattgcctccaattctgtcctagcacaggctctgtacaataaacatccttgcatgggtccctatagcaggctcaagatggaccccaaaggtatcaggtcctaatgcttggagtctgtgaatgttgccttatatggaaaaagggtctttgcggatgtgatcgtgttgaggattttgagatggggagattatcctgggttatcagggtgggctggaaaggaagtcacatgttgtattggttttctgtggttgctgtaacaaagtactgtaccacaaatttggtggcttaagacaatagaaatctactctctcactgttctggaggccagaagtctgaaatcaaggtgtcaggagggccacagtgcctccgaatcccctccttgcctcttccggattctagtggactcaggtgttccttggtttgtggcagcatcactccaacctctgcctcgtcttcacatggtcttccctgtctctctgtccttttgtcctcttataaggacagcagaaattggattaagggcccctcctactccagtatgacctcatcttaacaaattacatcttcaaagaccctatttccaaataaggtcactttctgaggttctaagtgaatgtgaatttggggggacattattcagcccactactcttatatccttataaaagagaagcagaggtagatttgacactcacacagagaaggcagagtgaagagggagcggagagattcgaagatgctggccttgaacatcaaagcgatgcagccgcagaccagggaaggctggcagccaccagaagctggaagaagcaaggagtggagaccccccagaacctcctgagagagcatagccctgctgacatctggggttcggccaaaggatactgattttggacctcttgactccagaagtatcagagaatacatttctgttgttttgagccattgagtttgtgatattttgttacagcagccacaagatactcagtccctttgtgggcctgcaggagaatttcttgaggttatacccaagaatgggcttactgggacagtgtgggcacagacaagatttggctaaatgctactaggtggctctccaaagcgcctgcatccatctagcaggactcccagcagcggcacacaatggttcctccttctgcttattctagccaacacttggcatcatacagctgatttttgccaatctgacatgtgtgtatcctatgtcattgttgtcatttccatttctccgattactaatgaatctgggatcccagcatctcttcacatacttacttgccagccttttcagtttcttctcctaagaattgcctatgcatatgctttgctcattttcctgttgggtctttttcttgttgttttgcagaatgttcttgcttattttatccattaatctcctgttgcttttaaacagcaaatatcttctccccatctgttgtctgtctgttaattctatctgtgctgtccttcatggaaaggaatccttaattttgctgtaatcaaacctaatttgagtgctcatttcagcaacacatatactaaagttggaactatatagataagattagcatggcccctgcacaagttcacgaagtgttccatataattaaaacaaataaaatacaataacaaatctaattcaaggctgacaacagaagggtggatgggtcagggactattgtgcaaacagagtaagtgctaccgtgtgtgtgtgtgtgtgtgtgtgtgtgtgtgtgtgtgtgtgtgtgttgtgcatgcgtgcaacctctaactgaatgtcaactcccaggaatgggtctattgcccaaactttaggcttaactgctcccctgctccctgcagtaacacatacagttcagtaaaagcagttctcagatgtccctgtgcactggaatcaccccagaggcttgctaaaacccagattactgggtgccacccccagagttgctgagtcagcaaatccggagtggaggcccagggatctgtgtcacagataagctcccagtgacactgatgttagtggcccagaggctcacttggagaaccactctagggtacgcagggaatgccagcatgttgctgaggctctgaagaaatagaaagtatggctgcttgtcagctggccaagcagcaccaggaagactgaggaagataggaaagtcactcgtaatcactgaatgccggtgctaaaaggcacctctggggccacaaaggccaaaatatttgacggaggtcaaaaatgagacccaaagggcgtcagttacttgaccaaggtcacccacttaagtggtggctgaggtcctgtgtggtggctcacacctgtaatcccacactttgggaggctgaggtgggaggattccttgagcccaggagtttgagaccagcctgggcaacatagggagactccatctgtagaaaaataaataaataaataaataaataaatgttggccgaggccagactgcctgatatcaatgctgttttctcttcacattccccaccctagttctcctaagggacacatgtgcgcccctccacagcttgaggacttgctttgaaatggtggaggggcgcccttgacagtcaccccataatatttcccaccagcacgacctttatcacagcttgtccagcagaaagaagccacgcagtgcctagaatgcatccatgtgacatgcagccctgccatccctcattccttcctttttgggcattctgagcagcactgggggccattgggtgtgtataggaagggaacgtggagtggtggatggggaggcctagacagatccgccccaacaccccggcagattctatccctgcttgtctctgtcactcacactggcagtaggcttcctggggcaaggacaagggcttcctcctcatgcccactggccccgcatttgggacccaatgcctctccccaccccccaggcaggagggcaggagagcaggaggggaaggggacttgatcctggcctcctcctccatctggcaagggagatagcatattttctgggctggcagtgaagaatggggaaggatagtggagaagctaaagccaggggcagcaacccctatgctatgcagctccgcaaggcgacagggccccctccaagagaggagactggctggggaggaagggaaatagagaggggagttggaggttggagagaaaggagggaagggaggtggggaggtggtgcaagaaaacagagaaggaggggggacagaggtgaaagtggtatggagggggaagggaaactgaaagggaggggaagaggacgcaggggagggaatgggcaataggcttggagaacgaatgactgaaggtggctcctccaagagggaccctgcagggaggcagctgggtgaagcggaagagcctctggtgccccagccacagcaggtagtgggggatggctcagtgcatggggagcgggaagctggggccctgggggctcctgtgaatgaggagaggacatgggaagggctttggaaagggtgatatgctttttgaaaaagaagcagtacagggggatggccctgacactatcagcccccactttacccctacccctaccgccccatcttgtctgtttttgtgttttctgagactagcttcactttttcgtttatttatttgtttagagacagggtctcactgtgtcacccaggctggagtgcagtggtgcgatcacagttcactgcagccttgaactcctaggctccagtgatcctcctggctcagcctcccaagtagctgggactacaggcacacaccaccgcacctggctaattttttttttttttctgagagatgaggtctcactatgttgcccaggctggtctccaactcttagcctcaagtgatcctcccatctcagcttcccaaagcactgggaatacaggcatgagccgtagcacccagcctttccaccccaccttgcattctccctcttacctttcagttctggaagtccagcctctcctgttttcagcaaaccatcagccaggctggggagattggcaaggcattcagagaccccagtgccatgggttgcctaccatgccaatcagaccttccactactcactgggccactgggcacccaactgcaccaagccccactggccttggggccacagagtggagtcaggcataggccctgccagctgggctcaggcctcagtgcttggccactgtcaaagggctgcttcgaaactttaccctcactgtgggtctttccgagccctttgcctcaaatattgaggaatgggccaaggaaaaggggcagaaggacatagccgggagtgacccttaagccctttggcctgccagcctctcgtctcttgggctgccctggctgtccatggcctcagcagctgccaccaccacctgtccctgagctcacaggatctcatgtatgacctcacatgttcctcacaggctttcattccttcatccaaatgcatttattgagtcctcacaattagccaggcactgagctgagccctggggttttcagaggccctgcgcacagggcgctgctatgaaccaacccctcatttccacagtgaggagggtgctggcacctctccagcattcctgagtttccccaagccctgggtctgcctctcccagtgctgcttttaccaggtttcctgggggcagtctctctttcaaaaagctgtcagctcagctggacctctggcctttggcatatgctccagccccagccagagaggagggtattgcccttctcctgccagcaagtcctccagccctgccaaaagccccatcttgaaccccaggttcccacacatgtgccctccccacctcaccaccccagctactgctacacaccaactctacccactcccagctggctacatgtccacaccttgccatgccctcatcttcccccaagcctcaagtgcctggccaggccctgcccctgccccctgccctagacctagccctctgaccagtcatcctgctagcagctcatactgctcaccacttgctgtctccttggcttccagattttccttctctctccctggctgctgcttctcctggtctcattcagactcatcctccttaacctatccttcacgagttgacatccaaataccaaatgatggggaggatacgggaacataggaaccctcagacactgccggtgggaatgtaaaatggcgcagctgctatggaaaacagttcgattcctcaaaaggttgaacatagaattaccatatgacccagcaattccattccagagtatatacccaaaagaactgaaaacagggactcaggagttgtatatcaaaacaggaactgcacacaaatttcattcagcattattcacaataaccaaaaggtggaaacaatggaaatgtctatcaacaggtgaatgaataagcaaaaggtagtctagccatacagtggaacattattcagccataagaggaatgaagcccaggtgcagtggctgcttgaaacccagagctttgggaggccaagacaggaggatcactcgagtccaggagcttgagatcaccctgagcaacctagtaagaccccatctctacaaaaacatttttatttttttgagatggagttttgctgttgttgcccaggctggagtacagtggcacgatctcggctcaccgcaacctctgcctcccaggttcaagcacttctcctgcctcagcctcttgagtagctgggattacaggcacgtgccaccacgcccggctaattttctttgtatttttagtagagatggcgtttcaccatgttagccaggctggactcgaactcctgacctcaggtgatccacccgccttgacctgccaaagtgctaggattataggtgtgagtcactgagcctggccttacaaaaacatttttaaaaataataaataaataaaattagctgggcatcgtggtatgtgcctgtagtcccagctactccggaggctgaggtgggaggatcactgtagcccaagagtttgaggctgcaatgagctatgatcatgccactgcactccagcttaggcaacagagggaggccctgtctcaaaaaaagagaagaagaagaatgaagtaccaactcatgctacaacatggataggccttggaaacattacactaagtgaaagaagccacacaaaaggacaaatatggtctgattccatttctacgaaatgtacagaatgggaaatccatagagatggaaagtagatgaatgggtgccagggactgggatagtgagaatgggaagtgactgcttcatgggtacagggtctctttttgggataatggaaaagttctggaactagatagaggtgatgattgcacaacattgtaactgtactaaatatcattgaattttacactttgaaatgctaaatttcttgttatgtgtattttaccactaaaaaaaaaaaataaaaaaaataaaaaagccagcattcgtttccttttgtccttggccattctacactcttactctgccttcagagtccagctccagtcttagtgccgctcctgcaaccttgtctcctgtccccacaaggccaggcttgctttcctctgctcccctctatcctctgcccttccatcctgctcttaggggcccggggcgtggtccagtttctttctgcatccccagtgcctgaaatagacctgaaatacagcaggcgcttagtgcctatttggcccaaaagtgaatgaacaaataagtcatgtcctaacccttcgtgctcagatggggaaagtgagggccagcagaggggaagtgacttacccaaggtcgcaggctggccagtggtagagtggagactagaagccttggccccagccactccacaggagccttttctatcctaacatatccctgcctgctcactcttcagcatcttttccagcctgcctgccctcgggggttcccatctcttctccctggctgcttctgggaccttgaaccaaatgagctctgggggcttggcactttggaaaccctgaagtcagtgctccctcctcacatcaaccccacttgcttctgatgattgcacacaaaggaaacctgcaggacccaaaggcaactggggaatagcccctggcaccagtaaagccaagccattcctgagacaatgctccctccatgggaaaactgctggaaacaggtggaaagggaagcctgacagtgtctgctatccatttggctcttaaggactgagtgacctgtctctgcccagtgcttttagcatcactcatgctgctgcaggcatgctccattctgtccccagtgagagggggctagcaggcgaaacactgcctgatgtctgtgaagttcacacagcacaactgtgcaccagcaccgctgtgctctgttcttccctggtttgcagaaaggacacaggtattgaaactcacagagaggtcccaggagcaggctggaggatgaggacctctaagggcaaacaggaacaggtcctgggagggccagaagccagagctcaacccaagggtgggtaggccagcctggacttctcaggccatctggttctccgtaggagagagcaaggtgggaacaataaagaaaacaagaattctggggctgggcgcggtagctcatgcctgtgatcccaggatttttggaggttgaggtggaggattgcttgagctcaggagaccagcctgggcaacatggggaaaccctgtttctacaaaaaaaaaaaaaaaaatgaaaaaaaaattgccggacatggtgatgcatgcctgtagtcgcagctactcgggagggtgaggtgacaggatcacctgaggctaggagcttgaggctgcgctgagctgtgatcacaccactgcactccagtctgggtgacagagggagaccccatctcaaaaaaaaaaaaaaaagagagagaaagaaagaaagaaagaaagaaagaaagaaagaaagaaagaaagaaagaaagaaagaaagaaagaaagaaagaaagaaagaaagagaaagaaaaagaaaaacccaggaattccaggaggtgccaaagagccaatctcgtgtcacttgccaaactatctgactttaccgctgcatttcttcttctccagggccacggcgcctcaggtgtgctcagcccctgaggaaggacccctggcccaggagtccgtgggcagcccctcctcatctctgtgccaagacggagtggcatggctttctgtgcttcgcctcacatgttgtagggaagcagagggaaggccagcaacaggtcagagctgtggctgtgtatccaaggaagcccccgactctagcccctctactcagggcggcaggagagctctgaagggccatgcctgaagtgctagggccactatactgacagctagaggagtccacagggcttgaaaggctcctgcagttctcctacaaacctaaattccactattagagatgggattctctgagttgaacgttaccctctttcctctggtttttttttttttttttttttttttttttgagacagggtctcactctgtcaccaaactggagtgcagagacatgatctaggttcactgtaacctctacctcctgggctcgagagatcctcccacctcagtctcccgagtagctgggactacaggtgcacaccaccatgcccagctaatttttatatcttttttggtagagatggggtatcaccgtgttgcccaggctggtctcaaactcctgggttcaagtgatccacccaccttggtctcccaaagtgctaggattacaggcatgagccactgcacctggccccttcctccttttaagctctatagtaatatttctaataatgcttggcatgtgtgcaatattagacatccctccttcacgctgtcattgctctagtatctggaggcaggcagggcagggattatgaatctgattttagagaaactgaggtccagagagggcaatggacttgcactaagggacccagctagcccagtactcttgaccttggacttatctgtctctacccctgcagtccacaactgatcgtaacatcttctttccccagtacaggaacaagtacacaactaactccaaaacaaaccctttcttggtggcctagaatccacatggaggctactgggtttagagtttagagtccaaactacaattcattcggctagcctacaaacatcttctggaatacctcgtgtgagctgggtcccaggctaggtacttgagggctgtggggtggctaataatggcttctaatccctgaatcctgtgaatgctagtgtatgtaacaaaaaggtcactgtggatgtggttaaattaaagaccttgatatggggagattgtcttggattatctaagtgggccctagatgctatcatatgtatccccataaacagggagatttgatgagacatacacacacacagaggagaggaccatgtgaagatggaggcagagattggagtgatgtggccacaagccaagaaatgcatggagccaccaaagctgggagaggcaggaaggagtcagttctaaaggctccagaggaaatgaggtcctcccaacaccttgattttggacttctgtccccagaactaggagagaataaatttctgtcatttttcggcactaagtttgtggcaatttgtcacagtagctacaagaacaaggaccagactctgcccttgaggagcacctagtgagttaatccgatacatgccatgtcgggggcatgaatgcccgaatgtagtccctctttcatgatccaggaatactatcctgggaccagggggcttccgagaggacagcatctgcttttaacacatgagaaacccaaagatgactctcccccgggcggggggatctggatttcctgtaacagagcttctggccctgccccctacctcccactcaggtttcaagatcacaggtgagtataaagaatggattgattacccttcccaggggcatttgccagttaataggtgctaaagtctcaggtcagagaactgagcctaatggagaaaattcagatccctgaaattctctcatcatcagtgtagctgagatggaccatagtcaagagggatgaggtaagggactcactcccctccccaccccattcctccatgggttgtccagcgttgcttgggatggagagaggcaggctggatgtggtggttcatgcctgtaatatgagcactttgtgaagccaaggtgggaggatcacttgagcacaggcgttcaaaaccagcctgggctccaggtgggccagcatctccccactggccaattcctggtcaccctgaacacacacacacacacacacacacacacacacacacacacacacacacacactggcttgtgtaccccaggggctcttccctttagctccatgaagcctgccagctttgaactggaggaagggaaagaagggagcttaggtgaaagccagacagctttgggggttatggaggtaaaagtggggccttgagctcttttctcagttcccttccaggaaaaaggggattactgtggcagggtccaaagctacgacagccagaagcttctaagaggtctatggagccagcctcctgtgcagcctagcagccgtggcagaggctactggtcgagtaataatcagaacaatggttcccagttacctgttcctcactatgtactcattaatgtactgaacagttagcaagtggttttcttttgtaatttaatttaatttattttttttaagacagattctcattcattgcccaggctggactacagtggcgcgatcctggctcactgcaacctctgcctccccggttcaagcaattctcttgcctcagtctccccagcagctgggattacaggcatctgctaccatgcacagctaatttttgtatttttagtagagatgggatttcaacaagttggccaggctggtctcgaactcctgatctcagatgatccacccaccttggccttgcaaagtgttgggattacaggcatgagccaccatgccgggcctgcaggtgttatttctttggtgatttctattatcatccccattttacagatggggaacctgaggcacagagaagctaggtaacatctccaaggtcatacaggggtaggaggcaggggtaggaggctgccagctccaaccaggaagctccttgaataagaaagctcctaaaactcctaaagctccaaccagaaaacaaacaggccaagcagactagctaaccatccttcccccatcaagacatcaccagctagagttgactggggaggtggaagtgaagcagaagtccccatcctcacaactctgcccctttccctgaagcgaaagaacaggcaccagtctcccagaagcccttgctggtttcagagagtcttttctccttcctgctgagggatatctggaagctgggcagaggtgaaggcctctgggctacaagaactgagggcaataaaatggtcagtagtgggtcccctggcagaaaggagactgaggggcaaggagccaagtgctgcatacagagagtggggtctggatgaaggcagggtgggaagtagggagagaagaaagcccagaaggacttgtcttgaagattgaagtttcttaccaacctgagctgcactaccgaagcagtagagtccagaccaacggccaaaaacatgggctctggggccagagagactggcccagctccatcacttactagcaatatgaccttgggcatggcacttcaactctctaagtttggttccttggccataaaactggggtgcccctaagatctactacggggggctgcagtgaaaatcagggagggtggatgtgacaccctcagggcagcgcctgccccgtactagatgccacattgagattagctgctattactctttggtcctaacctcagttgctgtggacagctgaatactgtctcctaaaagatgtccgtgtcccaatccccagaacccatgaatatatatgtgatcttatatgacaaaaaggtctgtgcagatgtgattaaggatcttgacaagaggagagtgtcctgtcttatccaggtgggaccacactagtcacaatggacttaaatagggaagagggaggcaggagggtcagagagaagatgtggtgacaccaggcaagcagagttcagaaatgcagccgtgaaccgaagactgcaagtggcctctacaagctggaaagacaaaggaacagattcttccctggagcctccagaagaaacacagccctgctgactaatgccttgactttagcccggtgaaacccattcagacttctgacctccagagctataaggtaatgtatgtgtgtggcttaaagccacgaagtttgtagcagtttgttcaaccagtgatagggagctaatacagctgcttttctataggtgcaagtctttcccagctgagcccattacttccccaagcctgctgtcctccttccccttggggtgcttcccttctggtgcagatttctgtcccagggcctgacagtctggggagctgatgaggtgtggttcccggaccagcagcatcagcatcacatggggacttgtaagaaacatgaatggtctggccccatcccagacctattgaatcagaaactctggtctgacacccaggaatctgcatttgaacgagccctccatgggatgttgatgcacactcaagtttgccaaccactgagctcattgatttgcatgtctgcctccctctttatagagcaggtagggattactgctgcccagggtcagccttggccaagagggacctgccgctatatgcccactgagtgcctctgtcccagcagctcttgggccatattatcattctctgcttgtagatctttcccactagactgtgagttctgccggggcagaggctgttttttgttgttgttgtgttgttttgttttgtttttgtttttttgagacggagtctcgctctgttgccaggctggagtgcagtcgtgcaatctcggctcactgcaacctctgcctccagggttcaagtggttctcctgcctcagcctcctgagtagctgggattacaggcaccagccactatgccaggctaatttttgtaattttagtagagatgaggtttcaccatgttggtcaggctggtctcgaactcctgacctcgtgatctgcccaccttggcctcctaaagtgctgggattacaggcatgagccactgcgcccagcctgaggctgtgttttcttgttcaaggttgtatgtattcttggcatctgagtgcttagtaaatgctcagtcaatacttaagagtatctgactgactgaatgaatgaatgaaaggtgttcccctgctgctagagagacacatgtgcctagctcctgtatttcctgtcacctggcagtgagatttaaaggcttggtcaaaggagtgtgtatttttgaaacactctctaggtgttttgtttaaaaacaaaaacaaaaaactaactccatcctgttccccttttaacctaggggaccgacctttcttcctcatggctttgtgaacaccatattcttcacccaggccactgcatctgcctgcttcccagcttatcaggacagccaggtagtccagcaagggcagccatagtgactgtggagagaagcataactggaatagtgagcatgcctccaggttgcatacaagaccagagcaaccacagcaaaccaaggtcagggccagagctgctgcttcaccttgtatccccgtggcacctgtccaggggctctcactgggggcctgctgggaaatgtgcgttgaatcaaattgacaataattaccaccggcttcaggacgggcgcagtgagagttggccctgtctgctgggccctcccctgcagctctcctcagggcctgggaacaccctgagctccacccctacgctgtacagatcaacgaattgactgcccaagtaagctaagtgggttatgacacagctttcaaagtcagcaacaaataatcactgactgctaatggtctataaagcacacacttatgaagaagccagccagatgaatccaacaggacccgaggcagcctgttgcttccaaggctggcctgtgatctctgttgtgctgggtcccctgcctcactccagatgtgctaggttaagaagcctatggtgctttgggtgcttctgatgaggagcctggaggatagtgccatgcaggagccagaaagaggaccaggctctcggggccagccctctgctcaggctccagccatagctgtcatgagcactccaagcaggcaagcagacctctactagagttctgggccttcacaggatggcggaggcagagcagttaggggccagctccaggctctagacagaggagggaaccgggttggaagagtagccaagacaccaaggcataccaggctgggtcagggcctgccacagagtgtcacatatgctcatgggtgacatgactattcttgttgctgtcgacatacactgttacattgcttccaggaatggcctcatcttctcttcactgcctaggtaggagttaagatagagcggcatcatcagtaactgattctgggccactgtagggtgctccctttaggaaaattgggacacgcaccactggggtccagtgatacgaaagtgggtaatcctgttgaaattgtcaacggtagaaaggaaagtttgagatgggaattacatgcgacccttcaggaacatctgaatcctcagagcttcctgcaaatcatggctgcctgcctggaggagagggtgtttaaagactgttagagacatccatagggttgaatagggcccatatggatgagcaggtgaccagctcaggcttccttcaggtaggggaggttggagatgctggatgatctcccaggtgattccagcatttgctggagcttacagccaacagtcaatccagcaatcccagcaggtcactggccaggaccagccgtggatcctactctgccagggtgagccgctgttcaggacatgctcttgcttgtctcccctccttccttccccctcttccctttgcctcctgccctggccctcctttttctgccccacactcccaccacctcaactgtctaatacccaggtctcctccaggggccccacattctctgccacttggagagctccctgcttctgaccttgatgagttttcccccgtacagtgcctcttctgaattctggacctttatctacccggtgcagaggcttctctttgagatcccactgtcacctccacatcaaaaaacccctcccttcagctccctctgccttccccctcccccagcagctctctcccagtctctctcagtctctgcctgaggcctctccaacctgacttcagacagctggtctctaagtgccacagcatggagaggtgttccctgaccttggccatcctgtggcttgtttcctcttctgcccctgccatagttcctacacccattccccctccctggcctcccgcaacagcctcctcctaacgagtctctgcctccagtcttttccctcctctgtctgctcccacctccccattgaacactcacttgatcactagagccgctaaatcaaatgcgaatttgatctgctcactccagttcacagtcttcatagctccagtccccacagggcccggtactgatccagattccttacttctccaggatctgcccaagcctcccctgtagtcagcagcagcctctgggtgtctgtgagccacagtctgagaagcactgacccagtccaaactcctcactctcccgggggcggggggtagcgtggaaacaaagcccagggctctctcctcatctcatgtcacttgcgaccctttcctgacactatggccacacacacagtgctctgctcattgctcagaaaaggcacaaatttctccttgccactccctttgcctgggctagacagagggagcaggccaaggttatggagcagggtggtgtcgggttcaggcaaactcaactggcacagccagcctttggcagtgccaggacagggtgcttcagcaggtacagctggcaggtgcaatagggcaatagctgagatggcctttgtgacaaggagattagtggccatatggggaaattgagcaaaaaaaaaatatgttgaggattataagaatcaggtttcttggcacgggtggggagggaagtgtaaatatggaagagtggcatgcaagaatcaactctgattgttggattcaaatggcaagaattggtgtgaattcccggttttagatagatagctgtttttcccctgtgtcgtcacattacagaaggggtaagggagctctctgaggcctcttctttttttttttcttttcttttttttttttttttttttttttttttgagacagagtctcgctctgtcacccaggctggagtgcagtggcatgatcttggctcactgcaacctctgcctcccaggttcaagcaattcccctgtctcagccccctgagtagctgggattacaggcacacaccaccatgcccggctaatttttgtatttttagtggagatggcgtttcacgaagtttgccaggctggtctcgaactcctaacctcgtgatccacccacctcggcctcccaaagtgctgggattacaggtgtgagccacggcacctgtccggggggcctcttcttatgtaggcattaatcccattcatgagggccccatcctcatgacctaatcacctccccaaggccccacctcataataccatcaccttgtgtgtggcaatttcagcacaggaatttgggaaagggacatacagagtcaatctatagtagcgtgtgtgcatgtgcatgattatacatccatctgtttcctagttctgtccgctgagagggcctagaagcaatgacaccctggtggcaatgagcatacccagcacccagatcttagtttctgaataatattgtccactgaaaggaaccaggtttcttaagaggaatggttgattccctgggacagtgaagtttcaagatgaacctgaaacatccggtgctgccaagaaagtcaggatgtgttcaaagaatgatgggaccatgagaaaaggggctgccactgaccaagtctgggacgatatgagcatcaaaataaacaacgaattgtatataaaccatggaataggagttcatgagcccatgccgatataaacaaacaggcaaacaaatgggagagaagggaaggcccttcctagagcagaacgccagctaataaatgtagaaggaacgatagcatgagaaaatcataatttggcaaccataatgataacaactaattcaggcaggaagtatcaatagatgctaaaactagtgggtgaaagtttaatgaggaacagaaatttatacaatcgcaagatacctcccccgatacttattaattgtttataaattaataagtacaaaagccctgctaattcacgttacagtggaaagatctgacaaataacactttaatcaagtgatcaaagttaatgttatcagtaatgatagcattatcgttattccgtatcattactccatattacattaatccatattatatgccacctgatagggtgtactgagaacacatcactcccaaggtattccagagggaatatcaagcaaatccaaactgagggacattctatataatacttggcctgtactcttcaaaaatgtcaaggtcataaggaacaaggaaagactgagtaactattccagattgcagtagaccaaagagacaacacaactacatgcaacatatggtctgggattggatcctggacgagaaagaaaaccaggaaaaataaagttgttgttgatgatgatgatgatgttgatgatgatggcaaagatttttgtttgtttgtttgttgttttcactacaaagagcattaattatttggacaatcagggaaatttaagtaaaatctatggattaggtaatgtcaaatgctaatttcctgattctcattggtgtactatggttttgtaggacagtgtctttaattttagaaaacacacactcaactatttaggggtaatggagcgtcaggtcagcaacttactttcaaatgatttggtaaaaataatagtgagagagacagagcaggagagagagaaccataagacacatatggtaaaatgttaacaattgggaatccacagaaaggttaaagaggtaaagagtccttttgttttgttttgttttgctttgttttgagacagtgtctcacactgccacaggctgggatgcagcggcgcaatcataactcactgcagcctctatctcctgggctcaagccatcctcccacctcagcctcctgagtagctggggctacaggcacatggcaccacagctggctaatttttattttattttatttttagtagagatgtggtctcattatgttgcctaggctggtctcaaactcctggcctcaagtgatcctcccacctcagcctgccaaagtgctggaatggcaggcataagctaccacacccagtcagtaatgagttctttgtactagtctcacaacttttctataagtttaaaatcatttcaaaattaaagcttgtttttaaaaagtatgaactcaggtctcctgcaccacttcctttcttttcctttcttgtaaaacatacaagaaatagacttgtatgttttatttatctatttataatgtgggccacatatgtaattattattattattattattattaattttagagctgaagtcacacctggctgtccaggctggagtacactgtctattcacaggtgccatcataatatagtatagcttcaaactcctgggttcaagccattctcctgcttcagcctcccaagtagctgggaatgcaggtgtgcgccagcacaatctcatgtttaggtaacatttgcaaggctacttttggctttagatgaacgaaccccaggcacactgacttacggtcacactttggttgtccttctaactgcatattatccttgatccctcaacttattcctcaaactttactttctagaaatgaaagccatccttagtgccaaagctcctttatcgtggaggctgtcacaaggccaggccccactgcctggagcgttctcacctgccccacttgggtggcacccacagggctgcccaactcaggccttacatggtgaagagaataatggcccccaaagatgtccatgtcctaattcctagaacctgtgagtgtgttaccttaaatggcaaaagagacctagcagatgtgattaagttaaggattttaagatgagagaattatcctggattatttgagccagccccctgtaatcacaaatggtccttataagagggaggcaggaaggtgagaatcagagaagaagatgtgatgatggaagcagaaggagaagtgatgtggccacaagccaagggatgtaggcagcctctagaaggcataaaaggcaagaaaacacattctctcctagagcctccaaaaggaatgcagccctgtcttaactttagtccagtgacacccatccgaaactcctgacttctagaactgtaagataataaattggtggccaggcacagtgactcacacctgtaatcccaaaactttggaaggccgaagtaggaggactgcttgagcccaggagtttgggaccagcctggacaacatagcaaggccctggccctacaaaaataacaaaataattagctaggcgtggtggcatgcacctaggtatggtcccagctacttgggaggctgaggtgggaggattgcttgagcttgggaggtcgaggctgcagtgagctgtgatggctccagtgcactttagcctgaaagacagaatgagaccctgtctcaaaaaacaaaccaaagaaagtaataaatttgcattgtcttgaaaccactaaacttgtagcaattccttacagcagtggcaggaaactaatgcaccttgtttcttccactctggagaatgtggagctccccaaggcctgaaccatgtcttgtcatgtccccatcccttgcagggcctcctcacctgaaccctgacccctagttggcactcaggaaaagtttgtttgaattcactcagccgggagaggcattgagccagggggtcatgacaaatgtgcaaggcctctcgcccctctctgaaggagttgggtttcctatggatgttcacattctgttctgtctgcccaagactggtcttgcttggctgtggtcgcaccaccagctgtggggatcgtaaatgtgtctgctgggggttggggtgagaggcgtttgaatgcctgggaaaggaatcccagacccaaagactctgcccaggaagcgtctggaagcctccttaccctagctcccagctgtgcagggagagatgctcttacaatgccaggagggcagggcaaaagctgagagctctgctacctgcaagtctagagcccaacaactgggtccagctggtgtctacacagatggcaggaccccaggtcactgagcttttcactttccagaactggggaggggaagaaaggggacatcttacgtccctgtgtgcatcagaatatggggtaaggcatagtttaaaagacatatttagggatggaaatgttctgagcagagatggtggtgatgattgcacaactctataaattttctaaacattactgagttatacacttgcaatttgtggtatctacattatacctcaataaatctgttaaaaaaaattataacatctctttagaaaacccataaggagagctgtattttcccagcgcaaaccactggaggtaaagtttgcattcatatttttactggtgaggtgtgggtttaaaaagctggggccccttggcagcccaccagggactcgcggggcagacactcggggaactcatagctctcctttgtctacagataccgccttcctgccctcagggagctcccagtcgggacagagagaaagtgcaaacagaaatatctaaatgcccgggatgcccaggagtgacaaggatcagtgtgaccaggggaagcaggccaggtaccggggactccagagtggggagaggaactggcaggagatggagttcccggacttcagcctctgtgccccacccccaaccaggtccccacaccaaccccctcctgccagctgtctccccctgtgccttccctctagccctgcttcagctcaatccattaccttctgtttacagcctcttcagacagttttccttggcttgatgcaagccaatttgaattaattttccaagcatgaccctgtgagtcactgtattaaatgccttccacatagttctcattgctgcacacacacggtgcattggccaaccatctgcaatcacaacgaggtgcccagccccacagagtggcgcccagcacgagcaacaacattcccaagagtggccctggtacaggccaggtgcagaaggatccacggcacacgttcttccagggctccttggaaataaagcgaggtggggcagctaaggaaggactgtccaacaatcagctttctttcatttaaacagctttattgaaatataattcacatagcacagagtcacccatttgaggtgtacaatttaatggtttgtagtgtattaacggagctgtgcaaccatcaccagccaattttagatatttttgtcactccccaaagaaacctcataccctttaaactattttcctcctacatctctctccccctgaccctaagcagccagtaacctactttctgtctgtgtagattttcctagtctggactttcatttgaatggaagtatatgatatgtggactttattggtcagcttttcaaaaggaaaattgccaaaggactgtagagcagcattttgcggggaggtgggttcctccatattgagaggaaggtgggcagaaaagggagaggctctcactccatctttgcaggagcatttccaggtgggatgtgaaaggggtagccctccactcggtgtgagccagtcccacccagccacagcctaaccttgtcctcccacctcgggaaagcctcaagttcttgtgcccacagagacctaccctttcttatgcctttaacatatcccccaggctggtctctcgtggagctgccatcccaaaaggagagagagagaaggagagctgcctgtccaattttcaggaggagctagagggagccctgttttctttcacagcccaggaggagaggctcccccacctgcttacacagtccatttcctaaagggtgcctgccatcacaggaatttactgtcggcctcttcctttctccttgctgaagcaaattggcctttctccagttcacaagagcatcacagagaatgctggcagcctccctgcagagtcatcacctgactcgctgtgtaatccacaaaacccgagcttctcaaggttggaggcttggaggctgtctggcccagactgctacacgcagcatgacaccaccaagggctcgtccaggctctgcttggacacctctcctctcctcaccacctcttgaggcagccccttgcctcctggtaaagccctgtaggaaattccctgctaccttgagctgaagcctgtttccctgtaacaaccttcttttgttcccatttttatggctctgacttggagagaaagttgaattccttctctcttttatagcccttaaggaatttaagacagatactagcccacctcaagagtcttctctcgtccagctgagaatagcaaccacaccacaaccatacttatatgagcacagcaacacacacacacacacataatatggaagaatcagccaagaatctccttgagctgctgtctgtgtaggctggagaaccaggaaagtcaatgatgtaattcagtgtaagtctgaagggccaggaacgaggagcactgatgtctgaagacaggcgaagatggatgtcccagctcaagcagggagagcaaattcacctttcttctgcctttttgttctcttagggccctccacagactggctgatgcctacgcacagcggggagggaggcttttctttactgagtctaccaaatcatatgctaatctcttctggaaacattctcataggtacagccagaaataatgtttgaccagatatctgggcattgtttagcccagtcaagttgacgcatacaattaaccatcacagtcacttgtgcttttggtgtcatatctaagaaaccattgcctaattcaaggtcatggagattgacacctacattttcttctaacaattttagcgttttagctcttacattaaggtctgtgatccaccttgagttaatgtttgtatatgatgtgaaggaggaggtccgaattcattcttttgcatgtgaatgtccaattttcccagtaccatttgctgaaaagactattccttctcccattgaattgttgtggcacacttgtggaaaagcaattgaccatagctgtgaggttttgtttctggaatctcaattctactccatcgaatagacatccattgacctatatgtctatccttatgccagaactctgcacatgcaattttttattcagggttataaagacaatataactgcaaagaagtattctccacaagacatattctttgaagcagaaatgtttttaattttttttttttttttttgagacagagtcttgctctgtcacccaggctggagtgcagtggtgcaatctcggctccctgcagcctccgcctcctaggttcaagtgattctcctgcctcagccacccgagtagctggggttacaggtgtgcgccatcacatccggctaatttttgtacttttagtagagacagggtttcaccataatggccaggctggtcttgaacttctgacctcaagtgagctactcctctcagcctcccaaaatgctgggattacaggtgtgagccactgcacccagccagaaatgtttttaattttgatgaagttcaatttatttatttttttctttggttgctcgtatttttgttcccatatgaaggaaaccattgccaaggtcacaaagatttacccctatgttttcttctaagaattttatagttttgaaagttgtagctgtcgtatttaagtcttggatccattttgagttaatggcaaggatggcttctttgatttacattctgttgggctcaatgtctcaattccccaagggcttctgaagaggaagttcagtcggagctccttttgctacaacttcatcaagagatttgggaaaagcaacatttcattagcaggtcctgaggagcctcctgccccacccccacacctttggagggagagactgagcatgggcaattttttttttttttttttttgagacagtgtcttgctctgtcacctagactgtagtgcagtgacacaattatggctcactgcagcctcaaactcctgggatcaaacaaccctccaacaacagcctcccaagtagctagcactacaggcacacaccaccatgcctggctattttatgtttctgtagaagcagcatctcactatgctgcccaggctggtcccaaagtgatcctctggcctcagcctcccaaagtgctgggattacaggcatgagccatcaaacttgactgagcacagggatttttttttttttttgaaacagagtctcactctgttgcccaggctggagtgcagtgacatgatctcagctcactgcaacctctgcatcccaggttcaagcgattttcatgcctcagcctccggaatagctgagattacaggtgtgtgccaccacacccagctgaatttttctgttttttagtagagatggggtttcgctgtgttggccaggctagtctcgaactcctagcctcaagtgatccacccaccttggcctcccaaagtgctgggattacaggtgtgagccactgcacccagccaacacagggatttttaaccacttctccccctttcaaatgaagaaacctaggttctggaggggaggtggctggccaaagatcacacagccagcaggttcacagctgaattccaatccatgttttctgattccaaatttcacgttccttctattctgccacaatgcctgcctacaatgaaacaagcaaaaatcagccggggacagaaagccagaccagtggggcaagaaggaaagacggtgagttcacagcagatcactcaatgagtatctgtcagcagtgaaggattggacataggagaatttccgggtcttttagaagaacaggagtaacatttgctgcagtgtgggtagtttctgtgaaagaaggccctgtgaagaaaaataaaggaactgagatgatttcacctactgcaaaggcctcagagtaaattaatggtgcttttccaggatatggatgttctgttcagaagctattgtacatttcttgtttgccctgagacgcaaacaagagcaaatgacatggccttccatcatggtaggagagatttaaattagcccccaagaagagtggaattgttaattaaaaagattctttagtgatggccttgaaacagtccatccactgggacccttttagactgcccttcatcctctcctgaggcagggacccagtcagccttgggcccatggttaccaagcatgttggtcgtgcaaagcagtgccctgggactggaagtggtggagaggctacatcacacaggaaagcagatttttccttgtggtatctccaaatgggaggatcctctacagaagacatagaataactaggttgtgaagtctcttctttcttttttttatttgtacttttttgagagaggatttcatttccgtcgcctaagatggagtgcagtggcgcaatcatggctcactgcagtctcaacctcccgggttcaaatgacccttccacctcagcctcctgagtagttaggactacaggcgcgtgccaccatgcctggttaatttttgtatttattgtatagatggggtttcgccatgctgcccaggctgcatggtttcaaactcctggactcaagccatcctcccaccttggcctcccaaagtgctgagattataggtgcccggacctcttccttctcttttagctctcactggtagtcttctgagagactctgtattaaatattatctctaaaaaggaactgtggctgggcgcggtggctcacgcctctaatcccagcactttgggaggccgagatgggtggatcacctgatgtcaggagttcgagaccatcctggccaacgtggtgaaaccccgtctctactaaaaatacaaaacattagccaggtgtggtggcgggtgcctgtagtcccagctactcaggaggttgaggcaggagaatcacttgaacccgccaggtggaggttgcagcgaactgagaatgtaccattgcactccagcctgggcaacaagagcgaaacttggtctcaaaaaaataaaaataaaaataaaataaataaataaaaaggaactgcactgtggtaggctggataacagccccccaagatggccttgtccttattcctgaaacctgtgaatatgtgaccttacatgctaaaaggggtagatgtgattaagttaatgatctcaagatgagattattttggactttccaggtgggcccaatgtcatcacaagggtcctttgaagaggtgggcggggggtcagagttggagatttgaaaatgttgtgctaggccgggcgcggtggctcatgcctgcaatcccagcactttgggaagccgaggcgggcagatcacgaggtcaggagatcaagaccattctggctaacacagtgaaaccctgtctgtactaaaaatacaaaaaattagccgggcgtggtggtgggcgcctgtagtctcagctactcgggaggctgaggcaggagaatggcatgaacccgggaggtggagcttgcagtgagccaagatcatgccactgcactccagcctgggagacagagcgagactccgtctcaaaaaaaagaaaagaaaatgtgctgctggcttcgaagatggaagaaagagccatgagccaaggaaggcaggtggcctctgaaagctacaaaaaggcaaggaaatagattgtcccctaggcctccagcaggaatgcagccttgctgacaccctcattttaagttttctgggccgggcgtgttgactcacgcctgtaatcccagcactttgggaggcgaggccggtggatcacgaggtcaggagttcaagaccagcctggccgagatggtgaaaccccatctctactaaaaatacaaaattagctggacatggtagcaggcgcctgcaatcccagctgcctggggaggctgaggcaggagaatggcgtgaacctgggaggcggagggtgcagtgagccgggattgcatcactgcactccagcctgggagacaggctggagtctaaaagaaaaaaatctgatagccagaattgtagggcaatacatttgtgttgtttgaagtcactaagtttgtggtaattagctacagcaacaataggaaactgatacatccgttaagctaaaggccagtcttagcattatagaacaaaacagactatgggtaaataccaattatcctaaagaacaaagtacaggttatttaggaaacttaggtttacttggagacttaggtttacttgttgcatatcagttgaattccagtgatcattcaaaactatgggtggaactaacccaacgtaattaaacaaaacaaccatgtaataacaagatagctgagggtgaggccctcatataagtttagtagaataggaactatatattatatgagtatatatgtaagaatagcacgaatccatgacatatttttggacacctttattgagatataattcacattccataccattcaccaatttaaagtaagtaattcaatggttttgagtacattcacagagttgtgcaaccattaccacagccaatttgatttcattttattattatcttttttctaaagttaggatcttgctctgtcacccaggctggagtgtagtggctcagtcacagctcatggcagccccaaactcctgggctcaagcaatcctcccacctcagcctcctgagtagctgagactacaggcacgtgatgccatgcctggctaattcttcaaaattttttgtagacatagggtctgactatgttgcccaggctggtcttgaactcctggggccaagccatcctcctgcctcggcctcccaaagtgctgggattacaggtacgagccactgcacccagccctgaagatgtctgcttctcatcctgatgtcctagctaagagaaggaaaagaaatacaattgaccctggatgggagggaccgtcggctttgctccaaagctgcaagatattgccaagactggaaggtgttctgggttgaatcaaatcccctaaaaagatatggtaatgtcctaacccctggtgcctgtcaatgtgcccttatttggaaatagagtctttacagatataatcaagttaaggtaaggtcataatggagtagggtaggccctaaatccaatgtctgatgtccttgtgaaaaagccatgtagccgagtggctcatgcctgtaatcccaatgctttgggaggccaaggcaggaggattgcttgagcccaggaattgaagatcagcctgggcaacatagcaagactctctctatcaaaaaagaaaactttaaagccatgtaaagacacaaggacagagacacatgaggagaaggccatgtgaagacaaagacagagattgaagtgatgcatctacaagttaaggaatgccaggaattgccagaagccaccagaagctaggagagaggcctggaacagatccttccctagaaactttagagggagtacggcccttggtgactgtttggtaaactcataagcaaatacagtcagcccttcatatccttggattctgcatctttggattcaaccaacctcagtttgaaaatacttggggaggctgggagcagtggctcatgcctgtaatcccagcactttgggaggccgaggcgggtggatcacctgaggtcaggagttcgagaccagcctggctaacctggtgaaaccccgtctctactaaaaatacaaaaaattagccaggtgtggtggcagacacctgtaatcccagctcctcaggaggctgaggcaagagaatcgcttgaacccaggaggtggaggttgcagtgagccgaaatcgagccattgcattccagcctaggcaacaagaacaaaactccacctcaaaaaaaaaagaaaagaaaagaaaagaaaagaaaatatttggggaaaaaaaaaacaatgaaaaataacaacacagcagtaaaaatactacaaatttaaaaaacaatacagtctgacagctttttgcatagcatttatattgcattagttattatatctagacataatttaaagtataaaggagaatgttcattggctacacacaaatattacaccgggctggggatggtggctcacacctataattccaacagtttgggaggctggggtgggcagattgtttgagcccaggagttggagaccagcctaggcaacatggtgaaactccgtctctacagaaatcagccaggtgtggtggcatgcacctgaagtcccagctactcaggaggctgaagtgggaggatcgcttgagcccaggaggcagagcttgtagtgagccgagatcgcaccacggcactccagcctgaacaacagagcaatactttgcaaaaaacaaaaacaaaaaaacccaccattttatacatgggaattgagtatcgttgggtgctggcatctgcaggggggtcccagaaccaatcctccgtggatacagaaagatgactgtatagctcagactttaagccaagcacagttgagggcacagagtagaaactcataaaggcctgatgattgctgggcaagccaaaagctacctggggaagagccagcaaggcctctgccaaggtgagatcacaaagcagatgggaaaatgtatgtcttcctggccacaaggcagaatgcctaaggcccataggcctttgtttcttccctcctcactttctgatccactagtagctctcagagcctgtagatggtccagacatgaaagaggtgagagctaaggggttcccctggaattctttttatttcttgtgattccacttcccttgaggtctcacttaaatttttcacccaacactccgaggttcctctaaattagcaggacttgtttgaaaataactgaagaacagataagtacttgaattaaatcactaaatccggaagtttcaatcatttcttggagtagaccctgcagagtagatttgttaagataatgaacatataccccttttaaccatgttctgccctttcagatgcccaggcagaggcaagctctgcccacagctctaggctaagggagcaggatcctctatactgggcaaactggtctgccaggactgaacagtgtggccctctgcatgcctcctattattccatggaacattccagcaagttccagagcaggcagggcattgcacataacacagctcagtcagaccagtggaaactgtctttagcaaggagcaaatggacaccaaatgccctgttcctgagtgcatacctctgattgcagtgcctttttgaagccgatcacatcaggaatgttttatttgttccctacagttgttataacagattactaacaacttggtggcttaaaaaaacacatatttattctcttacgtttctggaagtcagaatccaaatcagtttcactggctccaaaccaaggtgtatgctgggctgcccaccctcaggaggctctagagtataatccattttcctggttttttcagcatctacggctgcattcttggcattccttggctcatgggcccttcctccatctgcaaagccagcagcagagcatcatgcttcagtggtcacatggcccttctcctctgtgtgcaatgtccctctgtctctctctctctctctctctctctctcctttttgggggggggcggggggacggagtctcactctgttgcccaggctggagtgcagtggcacgatctcggctcactgcaacctccgcctcccgaattcaagcaattctccttcctcagcctcctgagtagctgggattacaggcgtgcaccaccaagcctggctaatttttgtatttttaatagagatggggtttcaccatgttggccaggctggtctggaactcctgaccttgtgatccacccacctctgcctcaaagtgctgggattacaggcatgagccaccgagcctggccccctctgtctctctcttatgagaacacttgtgattttatttagggcccatccagataatccaagataatctccccgtgtcaagatccttaactaaatcccatctgcaaagtcttttttgccatataagatcgcattcacaagctctgagaatcaggacatggccatctttgcaggccattattcaacttctcacaggagtagaggggaaactgtctgcctgtgggtttggaatctacattgaccaacccaaaccttctgccccaaatggcaatgagaaaggcttcaggatccctcaagaggctcttttactgctggtctgaattacaatgacaccagttcccattgtgctaaggtaaacagggagcaccgctcctgagatcaacagcagccaccaaccactggtcttgtggacacctggacctcaggtcagcaccatattccctgattactgcttcttgttaataggtcacctgcttttgcttactgatgtatcatggcactttccagccttcatatgtatggtagagcccattacagacgcagcagagtgaaccacatctgctaccccaaggaatgccctgtctcaatgcctaaatttcttccaagggcatagtggcatgccagcctgccaactggtccccctgacaaccctcctgacccctcactgccccagaatgaacttcccaatgcccatgtctccctacatcacaccctgataagcccttcagtggctccccatggctgacagcaggatcaagttctatggtccccacttgatcaggccctgtagatgggtcagccccatcttcaacaatacctcctttctctacctacagcttttactccctcctctctggattacttttgtctcctgaaacaaaccatgctaccttggtgcctttgtttgttttaaatacagaatggggtcttgccatgttgcctaggctggtctcaaactcctgggcttaggcaatcctcctgcctttgcctcccaaagtgctgggataacaagcatgagccactgcgcccggccttttgtgccttcgttgatggcagtctctcagcctggaatgcctacattctcttctgaaatcctccaaatgcactcagctttcaaggcttcacttattcaagagcagtgaggagatagtttgtgcctgctgggcgtcaggctggctaaagcacatacagtatttcctttagtcatctcaacagccctacaaagtaggaaaggctagtcctgttttcctccagatatgaaaactaaagcactgagatggaaggagatttgttcacagccacctagtgagtaagtgatcaagtctgtggtcggctcaatactgatccccaaagatgtccatgtcctaagccccagaacctgtaagtgttaccttatatgccaaaagtaactgtcagatgtgattgagttaagggtcttgagatggggagagtatcttggattatccaggtcaactctaaatgcaatcacaagtgtcccttataaaagtggggcacagagagattagacacaaaagagaagatgtgagaatagaagcaagagcttggagtgctgcaaggaaggggccatgagccaaggaatgcagccaacctctagaagttggaaaaggcacagaaacagattctctcctagagtctctaggcggcctgcagccctgcccgtgcattgattttagcccagtgagaccaattctgggcttctaactttcagaactggaagagaattaatgtgtgttatcctaggccactacgtttgtagcagtttgttacaatggccaaaggaaactagtaccaagaaagaatgtgagtttaaatatctctgacaccagaactcatgttcattcttctctctgtgcagcttcccaagggccacttcctctaggacaatttccctcaccaccccctccaaaagcaattctttccttgtctgtccttgcacttctgtgtatctgttattcactttgaaggcctgcctgacctatgccattccctcagggttgggactgggtggtgtatgcatctgtgaccccagcaactgcacagaggtttcaaatgcattcacgaaggaattcatgtatgtatggctacatacagcccaagggggccgtgggagttgtttgggccctatgccctgacaccaagcttatttaagaggtgtctgttcctaacacacagggaaacctcacatcagggtgcagtatatatatgtatttttgagacaaggtcttgctttgttgccaaggctggagtgcagtggtgccatcattactcactgcagcttctacctcccaggcttaagcaatcctccaccctcagtctcccgagtagctaggactataggtgtgtgtcaccctgcccagctaattttttgtagaggtagggtcttgctacgttgcccaggctggtgttgaactcctgagctcaagtgatcctcttgcttggacctctcaaagttccgggattacaggcataagccccagcctggatgcaatatatatatatatatatatatatatatatatatatatatatatatatatatatatatatgtatgtatatagacgtgtatgtgcatatatgtgtgtgtgtgtgtgtgtgtgtgtgtgtgtgtgtgtatatttttttttttttgagactgggtctctgtcacccaggctggagtacggtggcaccaccatgcctggctaatttttgtattttgttgttgttgttgtagagatgaggtctaactatgttgcccaggctggccttgaactcctgagcttaagcaatctgcccacctcagcctctcaaagtgctgtgattacaggcgtgagccattgtgcccagccaatcattttaaaattgagataaaactcacataatataaaatttaacattttaatccattctacaacatgaatgaactttgttttttgtttttgtttttattttattttgtttttaagacagggtcttggagtcaggtgtggtggctcacgcctgtaatcccagcacggtgggaggctgaggcgggcaggtctcgaagtcaagagatcgagagcatcctggccaacatggtgaaaccccatctctactaaaaatacaaaaattagctgggtgtggtggtgtgcacttgtagtcacagctactcgggaggctgaggcaggagaatcgcttgaacccgggaggcggaggttgcagtgagccgagatcatgccactgcacttcagcctggcaacagagtgagactccctcttaaaaaaagaaaaaaaaagacagggtcttgctctgtcacccatgctggagtacagtggtgccatctctgctcactgtagccttgacgtcccaggttgaagcaatccccccatctcagcctcccaagtaggtgggactacaggtgcatgccatcatatccgggtaattttttgtccatttgtttgtttttgtagagatgagatttcgccatattgcccagtctggtctcaaactcctgagctcaagtgatccacttgcctcagcctcctaaagtgctggggttacaggcgtgacccaccacacttggccgacaaatgaactttgaaaacattatgctaagtgaaataaaccggacacaaaaggccaaatattgtttgattccacttatataaagtacctagaatagtcaaaatcattgagagcaaatagattagaaatctccagtggggtctgggggcggtgactcacgcctgtaatcccagcactttttttttttgggaggccaaggcgggcagcttgcctgaggtcaggagttcgagaccagcctggccaacatggcaaaaacccatctctactaaaaatacaaaaattagctgggtgtgatggcgcatacctgtaatcccagctactcgggaggctgaggcaggagaattgcttgaaccctggaggcagaggttgcagtgagctgaggttgcactgctgcactccaacctgggtgacagactgagatgccatctcaaaacaaaacaaaacaaaacaaatctccaggggctgggggaagggagggagtaatagcaagtatttaatgggtatggagttgcagtttaggatgatgagaaagttctggagatggatggtggtgacagttgcacaatattgtaaatgtacttaatgtcaatgaattgcatacttaatagtggtcaaaataataacttttatgatatatatagtgataataaaatgtttaaaaaagacatttaccacttaaccattttaaaatgtactacctgtggtttctagtacattcacagagttgggcaatcaccattataaaatcaattttagaatattttcttcaccctacaagaaaccctgcacccattaaggagtcattcttcatccctctccccccagcccctggaaaccattcatctgctttctgtctctgtggatttgcccattctgtacatttcatataaatggaatcatacaacatgtgtctgattatgtgtcctatcttctgtgtctggcattttccatttagcctaatgttttcaaggtccatccatgtttgagcacagatcagtatttcatttcttttaatggctgaataatattccattgtatgactggatcacattttgtttatccatccattgcttgatggacatttggtttgctcccactttggctattatgaatgatgctgctatgatcatttgtgtacaagcattcctgtgaacatgagtttttatttctcttgggtatatatctagaaatggaatttgctggctcacatagtaactatgtttatcaagacgcaacttgcagtagaatccagcgcatcaactctgagtctctgagctgttggaggacatagacagcctagaaaacagaagggcaaaggcaattgaaagaatctcctttttagctcatacttccatttttctcccaccccaaagtgggtctgttattgagtcacaaaattgacaagtttgagtttgagctcccctcctgagctgtgaaatcaacccaagagtagggtttcagttggcagaggggtggtcaactggtacatctggagttgactttgtctattatctttctaatcatccctttagcctagaaagcctttgcctttagagctgttgggccaaaatctaaaatcagcttgtgaaagtgctgtctcgcagcctcctggtatgtgagaatttgtccatacttgatacacaaataactattttgctattgactgttcctcagcctgatctattcaaatgaatctctttgaagacatgccacctacagatcacggtatttcaacaacatttgaactctttccaagtataatctgtaataatttcttcattttcacaatatttgccctttgaaacaggccctgagcttgtgcgtttaaaggggggagtgggatttagagaatgtcaagcaagcgaaatggtttaggttggttcattctgttctgtgcccatgaatagcgcttgattcatggaccgcaagtggaatgttgaacaggacaggctcgtcatggggtacagcagaattagactcagcatactctccagactttctctctctgaccagatgggcaagccaagcctcaaataagcacaaatcctctgataacagtttatacttccaaacagcccacaggaaatgggacccttgataagagaagcagcttcacttgtaaattacaagcattcacttactaacatttaaactgacaattatcacagcttcaaatgctgggctccattggaaagcaagtcaagttgttcatctgttgggttggtggctgatcccttctgtggtttgcttacaagtgaaaaccctgctgctggttggaacccattctgcttgatttggacttgacagaagtacctggtacaaaggaaaagaccttttagcagggagaacagggtggcaggtgtggcccccagggggccactgaaaagccacagcagggtaagtcacactgcctgcaatgctgcaatggcactgagcccatgtgaaggcacaaggcctggtttatgttgccactgccttcctgtgtgaccttggacaagttgttccccatttctgggcctcagtcccttcctctttaaacatgggggctgaagcagattacactgagggaggcccctgctctattgtgctgtgcttggaaagcctctcatgtagctctcaatgcagatctgatgaagaacctgcaaggacatggattacatttcattttctttttcttgtttcttttctttttttttttctttgagacagagtctcgctctattgcccaggcttgagtacagtggcgctatctcagctcactgcaacctccgcctcctgggttcaagtgattctcttgcctcagcctcttgagtagctggaattacaggtgcccgccaccaaacccggctaattttgttttgtatttttagcagagaaggggtttccctgtgttcgtcagactggtctcgaactcctgacctcgtgatccgcccacctcagcctcccaaagtgctggcattacaggcgtgagccaccgcggccggcagcatttcattttcaagagatgaaggggtgtgttgagaaatgcactttacacatgtaccctaaaacttaaagtataataataataaattttaaaaaaaaagagagaaatgcactttagaattgtgttgtctggaaaggataggctaggccccaattcagcagctagaccctggccttgatctatatagaatcttagaaatcgtttcagtgtgtatgctttccgcattcatcctgtttctaaagacacgatgactccttttcttgacaactaaaagctcctggcatgagctctctcagtctcactctctgagctctggatcacagggtgagtgtggaaaggtgggcagaaaaatctgtgtatgattccgttcagccatgggtgggacgtggcagagcctcagaggtgtgtctcaaatgtggggctaaccaaaggacctgccaaacctctttttgcttttctctagcagttttggaacccagactttccatattatcctggctcaaccctcatgcgggaggagagtcatggggcctctaggttgaaaaggacctcaaagggagactaggctggatatcttgaagaatgggaactcccttcctacagaggcagctcctccatcttgaggttgttctgccccttaggaagttcccgaatccagccaggcaggcatggtggctcatgcctctaatcccagcactttggaaggccaaggcggggaggatcacttgaggccagcagttagagaccagcctgggcaacatagtaagactcatctctacaaaaataaaaattaaaaaaattagctgggtggggtggcatgtatctatcgttctagctacttggggggctaaggcaggaggattacctgagtccgaaagtttgtgtctacagtgagctatgatcataccactacactccagcctgggtgacagggtgagactctgtctcttttaaaacaagaaagttccagagtccatcaccctgtagcttttcccctttatccttattttcataagctgaggccacagaatacagatcaaattccccaggagctccctccaggagtctccctcatcactcctttcctttttaccccttacagtcatctttttctccggtccaaacactcaccaagattattcattgtatgaaaattccgacttccataggtcaggtgcagtggctcacacctgtaatcctagcactttgggaggccaaggcgggcagattgctagaggtcaggagttcaagaccagcctggccaacatgatgaaaccacatctctactaaaaacgcaaaaattaactggacgtggtggtgcatgcctgtagtcccagttactcgggaggctgaggcaggaaaatcgcttgaacctgggtggcagaggttgcagtgagccaagatcacaccactgcagtccggcctgggtgacagagagagactctatctcaaaaaaaaaaaaaaaaagaaaaagaaagaaaagaaaagaaaagaaaattctaacttccctttaacatcctgatcactggctcctgaagcaaatccagcctgttaatgtctctcagagaggctactggtacccagaacatgacatgcatccaggcactgtgagctgaccaggagatgagtgggatatcacctctgtccgtctagagcagaataagctcctcagagggtatagggataaaagatgtacagaactttctgttgtgattcaggaagcatctctaactctcttagcccgttttctgttgtttataacagaataccccaaactgggtaatttataaggaaaaggaatttatttcttacagttgtggaggctgaaacgtccaaggttgaggggctgcatctggtcagggacttcttgccggcggggattctgcagagtactgaggtggcaaaggacatcacatgtcgagggggctgagcatgctcactcaggtctctcttccttttcttataaagccaccagttccactcctgtgataacccattaatccattaaaccatgaatggattagtccactcatgagggcagagccctcatgacacaatcatctcttaaaggccccacctctcaatgctgccacactggggattatatttcaacacgggttttggagagtaaaagtcctgaaaccatagtaataacccagatgtctcttattgtgcctccttctcttcccacctacttagccaacataataacagttaaaacaaaacaatacgaaaggatatcgcttgttgagagcttactatgtgccaggcactgttctgtgcactttccatgtgtatcaatgtgtttcctctacacaaaagccttaagatgtaagtgccattattttgcccattttgtagatcaggacactgaggaccagagaggcaaggtgacttgcccaactttaaacagcctggctggctccagagtccatgctctctacatctatggctggatgacaccttctatatactgaatgaatgactgcgtgcccgtagtctgtcattagcaataagcaataccaggccccaatactggcttcaggaacccccttccctatgccttgggtccacaaatgcaaggtcctgtaatacatagaagcagaggtcctgccctggcatcaggaaagctaaaggtcagggatactcatcctggctctctactggtcctcttgaatggagccccagaacaataagcagccctgttgggttggcttggtctaccagccttgatttcaaggctaaggcagggtggaggacgcaaaaacccaccctgtaaagatcctctggataaaggcagaagacccccttcccactgacctggccattgtataaaggatctggggagctttgcctgcttatagatatggtagagacctggcgaatagctccttagacacattctgccaggactccccaggacaacacagctgttgggagttggggactccttgaaccctttttctgaagcagagtgaatgaggaacccattctcccttttctgactgtaagccctgtagcacacatctgtctaccagagaggcagttaagaacaggggtatgtaagccaggcttcctgggttcacatcctggtgctgccactcaccagctgagtgaccttgagcaagctacttaactgtgcctcagtttccccagctgtaaaatagatattaaaatagcaccgatctgtcttagtccactaaggctgctataataagatatcatagattgggttgcttaaacaacagcgatctcacacagttttggaggccgggaagtccaagatcagggtggtggcagattcggtttctggtgagaggtctctttctggcttgcagatggccatcttcttgctgtatcctcacatgtcagcaagagagagagaacactagtgttttttattcttataagggcaccagtcccatcaagggagccccaccttcatgaactaatttcctctcagaggccccacctcctaataccatcacattgggagttaggggttttttgttttgttttgtttttagtttttttgtttttttttagatggagtctcactctgttgcccaggttggagtgcagtggtgtgatcttggctcactgcaacatctgcctcctgggttcaagtgattctcctgcctcagcctcctgagtagctgggattataggcttgcgccaccacgcccagttaatttttgtatttttagaagagacagggtttcaccatgttggtcaggctggtctcaaactcttgacctcgtgacctgcccgactcagcctcccaaagtgctcggattacagacgtgagccaccacgcctggtgggggttagggtttcaacataggaatttggtggggggacacaagcattcagtccataacactatctcatagggttttatgagaattgaggagctaatgcctgtaaaatacttgctcagtgtctggtactgagctttattgagatataattcacatatcatataattcattcacatatatatatatatatatatattttttttttttttgagacacgatctcactctgttgcccagggtgcactgcagtagtgtaatcatggctcactgtagcctcaaactcctgggctcaagcaatcctcccacctcagtttcctaagtagctgggactacaggcatgagccaccatgcctggcaaacttttaattttttttttgtacagatggaggtctcactatgttgcccaggctggtcttgaactccttagcctcaagcaggtctcctgccttggcctcccaaagtgctgggattacaggtgtgtgccaccatacccggccattcactcttttaaaatatacaattcagtggttttcagtatatttacaaggttgtacaaccatcaccatctaattccaaaacattttcttcactcgccaaagaaatcctgctcctctttgccatcaactaccaacctcctcccgctagccctaggcaaccacttatctactttctgtctctatggatttgtctattccggacattttgtataaacagaatcatataatatgtggtcttttctgtctggcttctttcacttagcatcatgttttcaatgttaattgattttatagcatgtatccatactttatttttttacggttgaataatattgcattttatgagtagaccatattttgattattcatccattgatggatatttgagttatttccactttggctattaagaataaagttgctgtgaacattcatgtacaagtcattgtgtggatatgtgcttgcttttttctttctttctttccttttttttttttagacagggttttactttgtcacccctcactgtagcctcaacctcccaggctcaggtgatcctcctacctcagcctcccaagtagctaggaccacaggcgcacaccaccacactcagctaatttttcatatgttttgtagagacaggatgttgccatgttacccaggctggtcttgaactcctaggctcaagcaatccacctgccttggcctctcaaaatgctaggattaggccgagtgtggtgactcacacctgtaatcccagcagtttgggaggccaaggtgggcagaccacttgaggtcagaagttcaagaccagtctggccaaaatggcaaaaccccctctctactaaaaatacaaaaaattagctgggcgttgtggtgcacgctgtaatcccagctactcatgaggctgaggctggagaatcgcttgaaccccggaggccgaggttgcagtgagctgagatggcgccactgcactccagcttgggcaacagagcaagactctgtctcaaaaaaaagaaaaaaaaagtgctaggattacaggcgtgagccactgcccccggcctgaacatgtgctttcaattctcttgggtatatacttagccgtggaattgctgagtcatatggtaactctatagttaacttgttgaagaactcccaaattgttttccatggtagttgcaccattttacactcctatcagcactgtatgattttccacatcctcaccaatgctggttagtatctgcctttttgattacagcctccctggtggctgtgaagtgggatctcattgtgaactaattgcttcactttagagagtatttactggtttcatactggggctgggtccaaaagtgagagagacctggggagacaaggctttggagaggagacaaatctttcaggatttgttgtgagtggtcagagataggggcgggggaggtgtccaggaggggagaattgcccagattgagtgttagagacatcaatgcacccgctgcattttggaaatgaacaagtttgtaccataaatgcagtatcagaggtgtaggaggcatgccaaaggctgagacttggggtgcctggatgccaacactcagtagcttggttttattttgaagatgagttgccatttatgagctggggcgtgaaaagaagaaatctattttaggatgaccattctgattgccatgtggagcctgggttggtgggtgcagcaatgaaggcagtgggaccagggagcagctggacaagggtccagtaattcccattcgagatggagacagcaggagccaggtggaggtggtggcggcaatgaagcagggagggcccaaaaagacacagtaagcagacagtgagcagatccccaagtggaatactttcacttagttctctcccaatctttcactgcagaaagatagtcttggaaaaattgaaaagtcagagtttctaaaggaaaatccccacaggtgatgaggacagggggtgagggacagggcactgctcactcccccttactctgggcccagggccacccggcatgctggactctgatggaaagagtggaggtgacagaggaaagagagatccctgtgccaggagcaccaaatattctcctctccacgaagccaacttggacaatgtttattttgcaccaatcatatgcatggctcccagagagaaacgcaaggtacgatgtgtccctgacttccagaatcttcctcttgagataaattcaacatcaaggtatatttgaaaaataatagaaaatagaaatgctcacacaaggagatcacagatgattccttactacatttgtcctccaaaggcttcaagaaagaggtgcatcttgatccagggctcaggggacattcgcatttgggtgccagaatgcaaaggcttaagagacagtgcaacaggcaatggaaaccacatagcaaaggcaagaaggcagaaaggcatgaagcccactcagaaaacagtgaggtcacctattaggccagatgtactgaggtaggaaaagctcggcattgaatgccaggccaaggcatgttgcctgatcctgtaggcaatggggagataggggatattatatcaaaaaaggaaaggatcaaggtgatggacactctaaagggcgaggtaccactgagccagcaggggaaatcaatctgccttctgatgacagacacgcaagtgagcaattctggggctctaacagagaccagccacagagtgcacgaacgtacaagatggcaaatgtcaccctcaaggtcttgttatatctggacgggggccaaaaagaagtgtcaggaagtggagacctgagatcagaaatgggctggatatagaggacgatagagctagaagagccaggcgtggtggcacgcgccttactaccagctactcaggaggcttagacacaaggatagcttgagcctaggagtttgaggctgcagtgagctatgatcatgccactgcactccagcctggatgacagagcaagaccctgtctctaaaaataataataataataataataataataataataataataataataataaataggctggacatggtagctcatgcctgtaatcccagcacttggggacggcgaggcaggaggatcacttgagcccaatagtttgagaccagcctgggcaacatagctgggcttggtggcgtgtgcctctagtcccagctaccctggaggctgaggtaggaaaatcaattgagcccaggaggtcaaggctgcagtgggccatgaccacaccactgcagtccagcctggaccacagcaagatcctgtctcaataaataaataaatatatgagtgaatgaatgagaagaaataaacggagatggacaggtgtgcgggaatctctttctctttaggactctgcctatgcataaagaaaagtgtgaaagccagattcaagggagactgtgaagagaggtttcagggagcctgtcaccagtgaggctggcccccaaagtccttccagtgcattccagaggcattcaccagaggcagggcgaggcacaggagatgtgctatgggccaagcaagtggtgaaaacgaagattctacccgactgccctgaatctggggagggcagccttccattttcttttctaaaatgcatgccttaggaggtaacattttttaacagttttttttttaatgtggtaaaatatacatagcataatatttatcattttaatcatccgtaagtatacagttcagtggcattaattaaatcctcaatgttgtatactcataaccactatctttatccaaaacttttattatcatccccaacataaaccttatactcattaaataataagttcttcccccttcctcccatctcacaataacctttattctactttctgtctctaagaatttgcccattctgagtatctcgtataagtggaatcatacaatacttgtccttaagtgtctggcttatttcactaagcatgttttcagggttcatttatgttgtagcatatatcaaaatttctttccttttcatggctgaataatattttattgtgtgtatataccacattttgtttatccattcacctgtcaatggatactggagttgttttcaccttttggctattgtaaataatgctgctatgaacatgccctgctttcaattattttggttatatacacagaagaggcattgctagtaattgtttaattctttgataaaccaccatgttgttttctatagcagctgtaccactttacattcccaccagaaatgcatgagggttcaaactcctccacattcttgccaactcttgttattttccatttcttttaaaattatagccatcccacggccgggcatggtggctcacgcttgtaatcccagaactttgggaggccaagggggtttggattccctgaggtcaggggttcgagaccagcctgaccaacatggtgaaactccatttctacttaaaaaaaaaaaaaagctgggcgtggtagtgggctcctataatcccagctacttgggaggctgaggcaggagaaccccttgaacctgggaggcagacgttgcagtgagccgagattgtgccactacactctagcctgggtgagaacagcaagactctgtctcaaaaaaatgataaaagaaaaaaaaatcatagccattccagtaggtgtgaagtagtatctgactgtggttttgatttgcacttccctcatgattagttatgttgaccatcttttcatgtgcttgttggccatttatatgtcttcttggaagaaatgtctattccagtcctttgtccctttttaaatttttttgtggagacagggtctcactatgttgcccaggctggtcttgaactcctggcctcaagtaatcctcccactttggcctcccaaagtgctgagattacaggcatgagccactgtgcccagcctgtccattttttaattggaatttttcattgttgagttatagaagttcttcatattaatcccttatcaaatatatgatttgcaaatattttctcccattctgtagtttgttgccttttcactctgttgataacatccttgatagcacccttttaaattaaattaaatttaatttaatttttattttttagagataaaaaataaaaacagggtctcgctttgttgcccaggctggattgcagtggtgcaatcatggctcactacagccttgaactcctgggctcaggctatcctcctatctcagcctcctgagtagctaggtgatatgctttagatgtttgttccttccaaatctcatactgaaatgtgacgcccaatgttgaaggtgggtcctggtggaaggtgatttgatcgtggggacagatcctcatagatgacttagcactatccccttggtgataagtgagctcttgctcagttcacacaaaatctggttgttgaaaagtctggtacctccccctcacctccttctcatcctgtgagatgcctgctcctgctctgccttatgccatgactgtaagcttcctgaggccctcagaagaagccaagcagatgtcggtgccatgcttgtacagcctgcagagccatgaaccaattaaagttcttgtctttataaattacccagtctcaggtattcctttatagtaatacaagaacagcataatacactgagactacaggtgcacactgcaacactcaactaattttttaaattatttttaggaatggagtctcgctatgttgtccaggctcatcttgaacttctggcctcaagcaaccctcctgcctcagcctcttaagtagctgggattataggtacaagccaccacacctaacaacagtatctttgatgtacaaaaattttcaattttgatgaaatctaatttatctatttttttttcctttcttgcttgtacttttttagtgtcatatctataagcttgttgttaaatccaatgtcataaagattttcctcaatattttattctaagagttttatggttttagctcttaagttcaggtctttgatctattttgaattccattttgtatacagtgtaagataaggttaatgtgggttttttgtacatcctcttttttttttttttctgtcttatgagaagtaaggggttgaaatgatccagtactaggcattggttccaaagtcactaaagaactagttaagggggacactggtctcatggcatgagagtgggcctcagctttttcatctgtagactgggaatagtattgccccctggagtgggttgaatagtgtcccctaaaattcatgtccatcaggaacctcagaatgtgaccttatttggagacaggatctttgctgatgtaattaaaaatcttgaaatgagatcatactcgatttagcatgggtcctggtgactttataagaaggccaagtgaagacagaggcagagattggagtgatgcagctacaagggtggacatgccaaggactgcctgacagcagaagctggaggaggcaaggaaggattctaccctagaggaagcatggtcctggtgacactttgattttggactttcagcctccaaaactgtgagagaataaatttctgttgttttaagcctccacatttgtggtaatttgttgcagcaaccataggaaactaatatacgccctcatgaagtattgcaattattattattattatttttgagacagcgtctcactctgtcacccaggctggagtgcaatggcgcgatctaggctcactgcaacctccgcctcctggattcaagcgattctcctgcctcagcctcctgagtaattgggattacaggcgcccaccaccatgcctggctaatttttgtattattagtagagacagggtttcgccatgttggtcaggctggtctcgaactcctgatctcagatgatccacccacctcagccgcccaaaatactgagattacaggcgtgagccactatgcctggccgaagtattgaaattattaagtatgagatttgtcaagtgtttatcacagtgttgggcacattgcccagggcttctcgggtctcactcactgctgcctacatccatgacacaaagcagacccagccatcacctgccagtgtgccctccccagccccacaagttctctgaggtcttgttggcttaaacagcaggtgcctggcacatctgtctttctattagagagagtggggttggctggacattagtttgagcccggggttggccgctgacttgccaggtgacctggctaaagtcagtttccttctctgaatattactgcatctgtaagattgcagtaatgatagaaatggtgccatcctccgtgggttgccgggaggatttgacaaggtaatgcaggtggcagtgctcgatactgtgatcatcagagagcttgaaaccttagagatagtcttatccaaccaactcagtttacagaatttaaaaaaaaacaagccccagggaagaagagtgacttgcccacagccacgaagtgatctactaatacctcccctgtcccactgacatccaaatgagagagggaaagtgccttagctgctgaacactggaacccacagatccacccccagtagtacttccccaagctccagagaggcagccctggaaaagagtgggtttccagcagtcaagttgaagaaagtatttcaggcagtagagagtgatcaaccatgcccaccactgctgaaagatctagtaacaagaggactgagagtggacaaaggtaggggccagcaaactttttctgtaaaggaccagatagtgaatattcagctttgagggccatacaatctgttgcctctcctcgactctgacctggtagcacacaagcagttatagacagtatgtaaacaagtgggtgtgactgcgtgccaataacactctacggatactgaaacttttttgttttgtttttttgttttttggttacagggtctcactctgctgtccagcctggagtgtagtggcgtgatcgtggctccctgcagtcttgacctccggggctcaagtcattctcctgcctcagcctcccaagtagctggggctacaggtgcacaccaccatgcctggctaactttttattttttgtagagatgagatcttgctatgttgcctaggctggtgtggaattcttgggctcaagtgatcctcccaccttggcctctcaacttaaatactaaaaagtaaatgtcacatcattttcatgtgtcacaaaatattcttcgtttttatttttctcaaccgttctttgtttaggggtcacatgaaaacaggcagtgggcgggacttggcccactggccttagtttgcccagccatggtctcagcttttagatggataggaatgccttatcctacctcaggccaagtacattgaaaacttggagagtagagccctggcaaacgtggttttcaaagcttccctgatacccagcaattcatgtgtatacccgagagaaataaaaacacatgtccaccaaaaagcttgtatgtacatccgtgttcatagcagcattgctcacaatagccccaaattggaaacaacccaaatatctgtctactgatgaatggatcaacaaaatgtggtattattatacaattgaatagtattcagccataaaagacatgaaattctgatacatagtagaacatgaacgagcctcaaaaacattacgctcagcaaaagaagccagacacaaaaggccacatagtgtatggttccatttatacaaaatgtccacaataggcaaaatccataaagacagaaagattagtggttgcccggggctgggggagggctaatggggagtgactgcttaatgcgtctgggatttccttttggggtgatgggaatgttctagaactagatggaggtgatagttgcacaatattgcaaatgtagtaaatgccactaaattgtacacatttaaaggttaattttatattatatgaattttacctcaatttaaatgaaaaaaaaaaaaaaaaaagcttcctcaaagattctgtcatgctgctagggttgagaaacaggaccagtgtgaggagacagcaaattgcaaagcaagttgaactcacatctggattcaaagctcagtgttaaggtggactcagcatagggtctgtgagggtagaaggcatgggtcctgagcctttcctaggctgggaacagtatgttcttttatggcatgagggataaactgggaacggccaggtgaaggaaggaagggaagttattccagacaggtggagtggtggggtcagggaggtgacggttgtggggcgggaggcagtgtagaagggaagctggaatgagttgaagaattaaatagggaggcaggggcctgatcagatcatgtggggctgtgtagaccatgaacagaaatttggatttactgtgagtgagatggaaggcctgggacatgagactagagggttttaagcaagggaacaacatgatctgatttactttttaagaagcttcccgtggttgctgggtaaaaaaaacgggctggaggaggctgttgtgcagttattcagggcagggatgagtgtacacattcaagactttaggagacacagttctcaggatttggtaatggagtgagtgagaccaggggaggggggaacttctgcctccaaggtttaggccctagcaactgggagattggtggtgccatttactaagataggagaacacttgtgggaggagcagagtggtttggaggccagcaatgggcagttctgttttggacatcgcaatatgtctgcaaaagttatttttgaacaaaatgttattgctgttaattggatgccccattccacatttgtgttccgaaacattttctgggaggtttcttgggctgcttcaattatatgaaaagacttaattcaaagagaccaaatgttggtttctgtggtttgagtcccctgagtgcttaggggagacttcactgggtaagttaaatacagccctactctgcatttgggaggcaaatgttaagtcccgttcctacagaggtcagggtttggaggagaaaatactgcctcggaaatattacagagacatacgttatttcttgccaagtgcttatgcaaattccatattaactcgactgagcactagaaagaaatttacagagcagtctctcacattaggaaaacatgcaggtataaggttttgccctgcctgacttggcacacacaggcttcctgaagatggctgggtgttctgcatttagatttccaaggaagaggacgccttcccgtgataatgagccttaaaacgaagtcgtgacccaccggcctttggcatcgtcttcttttcttttgggatcatagtcaccatggccataattgccaatatcatcactatcgtgtggtcgttggtgtgttaagaaaattcctcaaaccaccaatgggaatcctaacaggaatcaaaaaagatgagatgattcctatctcattgaaatttgttgcattacattacagagggtcccctttgggagtgagcaactctgctgcatgtaagacaggagtgattggtggtggtggtggtggtagggggtgctgctctgcagaaacatggcaatggaagatgaccctgctgtctgtgaagccgctgctcctgacccaccacactgggctgtttctgggacaagcaggcagagcaggagagtctccacgccacctcgcccttcctcctgagcccagccaaagcattcccgggacttctgcactgcctcctccctctccttccccacctctgtctcttctccactctccccagcttttcactctaatggctcctgtcacctagagcagcattttctgggttctgtacaacagagtcctgagactccatggataaatgaaatcatggaacgtcaatctgatcttatcacccggcagtaccaccccatccccacttaacactcctgggggttcatggttgcctttgagtacagtccgatcttcacccggtctgcaagtcctgtgtgacctggttccagccaattcgattcgacgtgttgcccttcctctcatttcagcggttctctcagaacaccctgccgtctgcaggccaaaccattatttctttgagtcagctctacactgaccatgcactgggagaggggctgcacctccgtgttcccatcacactgtgtgctcaactctttaaccacctgcatcacacagagtaataattgcctatcatctgtctccgcccttggacttccttttcttcccagccctgagaattgggccaggcctacatacccaggccctcttttctatggcaattgctacctccaccacgtccacaccaggaatccaaactcctctctccagccccacagtccccagcctctctccctacatgatgccagtagcactcctgtagaccagttccctgtcgctgctgcttcatgcttaaaagcgttcagtggctcctcctctgttttcagaaccaaatctttgctcattagcatggcattcaaagccctgcctgtccttgccatactgtaaaatccaagagaggagagaataagaaggctgtggagaggcggaggagactaagggataatgtgcttacgactcaaaaaatatcagaggaaacattgttttagaatgcattttcagggcttctgtttacatatggggtgtgttccaaaaattcctatgtatctgggcctcggtgggctgaatattattgggatagccagcggttcccagacttgtgaacttcaccaatgagtagatttcttttcttttttcagtttggggacgggtagggttgccaacttcttattttgcaaagtaagcatattaaacaaaacactaccatcttttcatgaaataaaaggacttttgtataccaaaacaagttcatgatttcaagataaaggtcaatactctagctttatggggggaaacttgccacgacaacctcatttttttgtatttctcctgggactggtgaaacttgactgtgaagtcaggcatttgggaaaattgctgtagagccccatgcgcccctccccccagccagccagggctgtttgcatgcccattgagatgcaagtgagtctttgtctcttaattgccccgcacagtggggagtgaggtgggaagggagggtgtgctgtccctttgtacccagccagggccctccaacaggtttggttagagggattaagctccaaggctgtgggagggtagacgaagccctgagcaccagcagagctgctttgggtcccagggcacagaaggtgaccttgagttggggcaaagcctttggtccctgccctcattcccatgtggactccctctcggctctggtccctaaggatcaatggcggggtgggtattcaggaaggggtgctgtcagcatggacagtggtgctctcctgatgggcatcttcagcagtggtgggggtggtggcaaggcccttccacagctgattttgatcatgggtgagggaggccacccaggtactcagatagctgatttggaatttattattattttgtatttttctgtgctctgcacattcagaggacattctctagtaatgtactacagaaacaattcctgaaagtatagtctttgtccccaaagtatataccatgtgtgggggcggggagcacggataatggctttgaaaaatttttttttaataataatattttttttctcctgggaaatacacttccaaactaagttggggaggtgctcccagatcatggtttttaagtgcacaatttcctgtatgcaaacccatgacccatggatacctagctggcccacataatcctatttacctgagattggtgtaaacccacccagccctatatgtgtgcctctcctgttttcccaggccaccctggtggctgtttatccatgccacactggccacagcttgggaaaggtggacatttttaggagagaatcttgtcaggccaaatggttttccaattgatggcagttttcagggtatgagaagttcagggaggaactaggtgtagcaagagggtgggaacaagggagtggtgtgtagacgaggcaggcttgggcaagagtgggtccctgaacccatgtgcattggcagtggggagtatagatgatgtgtgggggcggggagcacagataatggctttgaaaaaatttttttaataataattttttttctcctgggaaatacacttccaaactaagttggggaggtgctcccagatcatagtttttaagtgtacaatttcctgtatgtaaatcaactgcatgtttaattgcaattcagcaggatagcagtacctgactgagaggctcactaagttcccagcaggtcttcagtctggcaggcaaatcagccctctctaactcacattaacctaacttacaagagactgagagacaaaccaggcccaagataagctattttacaaagggagaggtatctggtaggataatccatctcggacatttgcaatattttgattaaggaactatttgtgagtatcttttggccacaatgataaacattgtccttttcttttggttcttattcctgtgtcagagcaggtcatctatgttcattttgcgctttagaggagcacactcttaaggtcccatatcatcacctgctaatgttcatccttgccatggttcaatctgctagaacggaggtcagtaaactttttctgtaagggttagacagtaaatattttaggctttgtgtgccccatggtctctatcacaactgttcaactccactgtggcagcacaaaagccaccatagggaatacaaaaatcaatgggcgtggctgtgttctcataaacttcatgaaccctgaaatttgaatgttgtatcactttctcatgtcataacattcttttgatttttttcaaccatttaaaaatgcaaccactacttttagctggaaggctgaacaaacaggtgggagtaggatttagcccacggggtgtagtttgagaactattcttgagctagaagacagtcttattgcatatggcattgtagcacctttagcagctagagttccagttgagtgtgactgtccactgcatattgattgacatggcctcaaacttaagaggttacatgcttctcacctcctcagtgtagatgagtgtgtatgcatcagggtttacccatcagatcctggaagactcctaaagaccagaaaatctactgccctccaggtacagatggtaccaccagggcctatggaatggctcagggcacttagtagcaaaggtgggggcatgtccacagcctggaatagacagtaacctcctgacctcacagtggccactatttccttagccgttactagattaaccagtaatggtccctgccctctgtcactgtgtgcaggctgtccacttttcaccacctcatttaatccttagcacaaccttgttgggtttagccaggatttgtacccggtctggctctacagcacacattcttagccattcaccagctggggttcctagtggtaccctccccctttgacacatgagactagacctggctaactccccaacctcaaggaacctccattttgctgcttttccctcgttaataggtgatgatacataaggcattgtgaggaataaaaattaagggtaaaatgcctggaatatgccatgtgtatagtgtgtgttcaataactaccagctatttctgttaattctacagctagaatggaataatgttccattcatagagtaattaatgccctgagcctgggaagatccactcctcatatgctgttttgtttctgcagccctaagattcagggcaatggatgtaagccacacgggagatttcggctccatctcagggagaccccacaccccactgttccttaggggttggtgggagccactgaggggggtgcctatggcagcgagggctgggttgggggcacaggaaagctgccgaatggatattgaggggaggtggtagtagccgccctctaaggaggatgtggccctgggcagccggtgccgcataatggcagggacaggctcacgctaccactccggagagcagtagcgcttcctctttgtcttcgagagccggttgcagctggggctcttctagggagcgttcccatcaactgctgcagcgggcattttgctggtcggcacagtatcgtatcggaatctgatttcttcgggtctgggagacggactccgtttgcgggggttcatgggaaaggactgcagcgcgtttgtcggtcattaagcacgtttttgagatcgactctgcagatatgaacttgcactttcagcgcattcatcaaagcctcgggagagctgacccagtccctacccccagtctcccgagcccgcggcgcttcggctccgggacgcccccatcctcccctgtcgcccacccgggcgcccccggcctcgttttctcgagacgtgtcactgcttgttgaccgcagccagtcacgaaaacggtccttttcttcagtctccggccagggtttcactcctgcagggaacagcgggtggggacagagtgcggggctccgtgctggacggtgtctggaggggccccaagggaacaacccttcaccgggagaacaccaaggccagaaggggaagagcccttctcaaggtcacccgggaggaaatcggcgcccaccggcgctgccgcctcccgctccccggcactggtgactcactgctccaggtccgcggggccacctccgagacttcggtctcgaggaccgaggtgggacagggtctgcggaccgcgcgctgccgctggacccagcccaacccaacccaggcctccccacccaccgggtgcccgcaggccacgcccctcgcccggagccccgcctccagaacgcggccccgcccccgatactgcagcctcgccccgccccccggcctaaccccagcccaggcgccctcaggcgccggctctctagcgcgcccgacctccatcttcccggggccgcgccgcgcgcgcgcgcgggctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggtaaggcgggcggggggcgcgcggggaccgcgcggggaccccgccttgtgggcccaggggtcgctctgcgcatgagcggcacggtccccgcctctcgggcctgcggtggctgccaccggccggcccggctgtgcgaggcggagcggcgggggtccgagccccgggcccgtgggggttgactccgccgcggtcggagtagccggagaggaggggtgggtcccctcctgacgctgggctggaaacagcgggatgggccccctaaaatcctgaacgagcaggtgtaccactggtgacaacagctgtccccaagagtttacctttgagaaaaccttgaagagagcagtcattttcgaaatttgctgcgaggccaccgacagcagaagcacctggggaacttcctaggtggattcctagcccctttcatcgggatcacagcgggcatgggctgtggggggggggggggggggtcagcgaggcgtaggtctaaccagctctctaggtgcttctgccgtccgcttcagtttttgagactttggtcatgttttgccaaggagcaggagagagaaatcccgctgaatcaaggaagcacgtttcttagaccctctgctactcaaaatgtggtccagggcccagccgcataggcatcacctgggagcttgtaagaactgcagcatctcacgccccgcccccgacctactgagtctgattctgcatttcaactagatccgcgggtgattctctggcacattcaagtttgagaagcatcttagtagaataaatgcagtctgtggttaaaaatagggtcttaaacatgtaccaacagaatcttcttacacttatttatatcctatgtccccatcagaaaaagggattaagggaaacactgtaattgaacgtgaattatgctccaagcttcctgacaatagaagcgaacccagctggtggaaaatatgtgagctcaggaaacacacacacacacacacacacacacacactttgtcctagtactgagttctagtaagatttatgtcacataaaggaacactggaaaacagtggatggtactagccaagccacttttgcaaaagatgcagaaatgtttttcatgtgggcaacccacctggagttgattcacgaagagccatttaacattctgcagaggtgccaggctctgttctaggaactgatgatgcggtagtgaacaaaattgagactgtcttcatggagcttacatcctggtccgggcagaaaacaagcccaacattgaaatctatatatattgtcagtgctatggagaaaaataaaggaagttacaggggtaaagagttgttgaattttctttttcattttccctttgggataaaatttttattttgtttacaatgcatttgtaggaaaatgtatgatcatttgattgacttgcatctaatgacatggaaatcttgaaagtagaagcacaaaaaaagttagaaaaatgatactcccttcaaagctgtcttctgaaagtcttcaacatggtgtgcccgttgagaaggtggggaatagaaatgattgggtctcagatttgcacgttacaattgttgatttaagaggtggtagaggagacagaaacagtacatctgttttatagatgaggaaacagaggcacagagaggtgaagtaacttgccttaggtcacacagcgattgccagaattatgatttgatgcaaggcttgtctgactgcgcagtcactgcctttaagccctaggcatatgcccttgcacctggaggtaccccacttcgactacttagggaccatgggaaaatgagttccccgaacttgtttgatcatccatatgatgcctgacaatcacaaaggtgttttgaggggaccaggcttagatctacagccttgctaccagctaccatctcctgagttcttcctgtgtgccaggcacttcacatatattgctttaaattgcctcgacaattttgcaggctagatattatcactggctttcagatgagggggccctggtcatatagctcagaagacatagagccaggattcaacccagataagactgctacccagttatcttttattgtttaaattatttttaattaattaattaatttttttgagacggagtctagctctgttgctcaggctggagtgcagtggcctgatctcggctcaccgcaaccttcgcctcctgggttcaagcaattctcctgcctcaggctcccaagtagctgggactacaggcatgcgccaccatgcccggctaatttttgtatttttagtagagatggggtttcactgtgttggccaggctggtctcgaactcctgacctcgtgatccgcccgcctcggcctcccaaagttctgggattacaggcgtgagccaccacgcccagcttattgtttaaattaattaactgaaaccagaagcagctttggtttcaagataagggcccagttttctggatcttttttttttttttttttttggaaacagagtcttgctatgtcgcccagactagagtgcagtggcgcgatctcggctcactacaagctccacctcctgggttcacgccattctcctgcgtcaacctcctgagtagctgggactacaggcgccagccaccacaccggctaactttttgtatttttagtacagacagagtttcaccatgttagccaggatggtctctatcccgtgacctcatgatccacctgcctcggcctcccaaagtgctgggattacaggtgtgagccaccgtgcccagccaacagttttctggatcttttgtccaaaataagataatacgatttttgcattggtggtcttctctgggatcctggtagtctcagagctgctgcgtcaaaatgacaaacacaaagcaagtgcctcagttaggcaccagttggctcttcttgggccctggagtggcattttgggtaggcctgctgagagccactttattcttggtcctggtcctcagtagtgggatgtggctgagtaaccctggcagacctcagaaagcacacagaagcaactctgcataatctgagaaatccttccaggctctagcaagtagcaagtagaggctggctttaggctcccaggagtttaaagggcggttaacaagttatctttgttctaattacagagggcttttcagtctgctgtgtattttactagttccaaaaagtcctctgaggacaggtatgctgcctgtatgtgcctccagaaatgggaagctgttcttttgagcagcaaggagaagactgtcagtgatgtggatgggtagtaatcttaacaggagcttcatttctggaacacctatatgccaggccctctgcctcgccacattaccccgacctgttggcactgtgacccatatcacctcctgatgtccatagtggcccttttacatagagtcttacaggtaactgtttggtaacccacttctcagatgaaaaatatggggcccagagaggtttaggaacttaacacttagctgaattggatttgaactcaggtttacctgcataaccagagcagaaggcatgaacacagataccttcagggatcatgcaggtaataggaatgtgagaagtggtcaagaataagcatgatgagggggccgggcgcagtggctcatgcctgtaatctcagcactttgggaggctgaggtggccagattacttgagctcaggagttcgagaccagcctgggtaacataacaagagccccatctctacaaaaaatacaaaaattagccaggcgtggtggcatgcgcctgtagtcccagctactcgggaggctgaggtgggaggattgcttgagcctgggaggcagaggttgcaatgagccaagatcgcaccactgcacttcagcctgggtgacagagtgagaccctgtcttaaaacacacacacacacacacacacacacacacaaaacaaaagaataaaagaataaacttgatgagcatgttggcaagccaccaagtgcctgctcccttaaagagaggtccagcttacacatggagtgtaggctttaaagcgtacctgcccagtgctgctatgactctgtcccatttgcctaactgctcggtgctacggtttcctcatctgtgaaatagggataacaacactatctacctcatggggtggttattaggattaaatgagtagaaacgtataaagcatttagcacggcacctggctccaagtgagcaagacattccaagccacattttaaaaatatgtgatgcaaaccttgaaaggcatcatttatacaaaatgtccagagttggcaaatccatagagacagaaagtagattagtggttgccagcagctgggatgaagggggatggggagtgtctgcttaatgggcaaggggtttctgtttgggatgatgacaatgttctggaactagatagagtttatgattgcaaaatatgtgaatgtactaaaaaccatgaattgtacactttaaaaaggctgaattgtggccaggcgcagtggctcatgcctgtaaacccagctcgttgggaggctgaggcgggtggatcagctgaggtcaggagtttgataccagcctggccaacatggtgaaaccccgtctctactaaaaatacaaaaattagctgggcatggtggtacacgcttgtagtcccagctactcgggaggctaaagcatgagaatctcttgaatccgggaggcagaggctgcagtaagcttagatcatgccactgcactccagtctgggcgacagagcgagactctgtctcaaaacaaaaaaaagggctgagttgtatgggaactgcatcttcatttaaaaattcactatgtactgacttgtacactttaaaagggtgaattgtataggaattacattgccattaaaaaaaattcactgtatagtccaagcagaataagtgtgagaagtggcaacatgttacccctggattggggttgttttcaaggtccttgaacttggttcggggggcgtaagagcagagtgggccccgtgtgctggcagtgctgagatgccaggctgggatccaagcagaagcctcatgggctgacttggggtattgggctgagccagatgggccacaaagcatctgcagagttggcccagagatgcttaaccctgcctgcccgagttcaggagtggtccctggaacagtggcatgatagggagagggagaacttccctttcctagatggctccagggttgcccttatgggcactagtcagttgctgcgctcgtctgacagaaagtctggggactctgcctgttagtcttacctgctttgactggttttcagccttttccttgctgtcataggtcacatccctatcccttccattattttggacacagggtatctcaaatgtgttgtttgtttctttgtttttttttgagatgggagtgcaatagtgcgatctcactgcaacctccacctcccaggttcaagcgattctcctgcctcagcctactgagtagctgggattacaggagtccgccatcacacccggctaatttttttgtatttttagtagagacggggtttcgccatgttggccaggctggtctcaaactcctgacctcgggtgttccacctgccttggcctcccaaagtgctgggattacaggcgtgaaccaccgcgcccagcttgtgtttgtttttaaacacgtgcacagaaaccatccaggagtcagcatcagtaggcattgaggaagggcctgaagttgccttcagtggagatgatgctgattaggcccattttgtctgctcagaagggagtgttgggaggagctgggtttcattcttgtgagtttaggagagataccttccagatacgtcgactttcctgttctgttcttttttttttttttttttttttttttgagacagagtctcgctctgtcgcccaggttggagtgcagtggcgcgatctcggctcactgcaagctccgcctcccgggttcacgccattctcctgcctcagcctccctagtagctgggactacaggtgcctgtcaccacacctggctaattttttgtatttgtagtagaggcgaggtttcaccgtgttagccaggatggtctcaatctcctgacctcgtgatccgcctgcctcggcctcccaaagtgctgggattacaggcgtgagccaccgtgcccggcctcctgttctgttcttttccccacctggtgttttgctttttctgctgtgtgttcactcttaggtgggtttatttatttatttatttttattatttttttccttcgagatggagtttcagtcttgttgcccaggctggagtgcaatggcgcgatcttggctcactgcaacctctgcctcctgggttcaagcaattctcctgcctcagcctcccgagtagctggaactacaggcatgtgccaccacacccggctaattttttgtatttttagtagagatggggtttctccatgttggtcaggctggtctccaactctcgacctcaggtgatccacctgcctcagcctcccaaagtgctgggattacccagctcccaaagtgagccaccacgcctggctcactcttaggttttgtactttgcatgttattcctcttctgctcttgggtgcctgggaggactggctcaaggggttcctgtcccccaatccagactggaccctccctgaggctaggtccatgactggtgaatgttggtttgcatgcaaaagcttaacgtcatcgtagacacctatcaagaacgggctggaaaatctttcatgtaggcacatgttccacatggagtggggtgggaggctgtggtagaaagaataataatgagcccccaaagacatccacgtcctgatctctggaacctgtgaatatgttaggctccatggcaagggaaattcagtaaggtagccgatggaattcaggccgccaatctgctgaccttaaaatattattatcctggattatccaggtggacccaatgtaatcacccgggtcctttaaatacagaagagggaggtagaagagtcggggattagagccatgtcatatgggaaggactcgcctggccattgctggctttgaagatggagcaaggggccaggaaccaaggaccacacagcctctagaagctggaaaagacagggaacagatttttctctaaagcctccagaaggaacacagccctgcccacaccttgagtttagcccaatgagacctgggttggacttttatctctagaactgtgagataataaatgggtattgttttaaactgttgaatacagtatattttgttatagccaaaacaggatgctagtaagaagctaagagttagatactagcatcctcttccttgtttggaaaactagtatgtgatatttccttacattgtttcagttttaccattttaaaatcaatccctagaatgctctaagttcagcattttaaaataaatgtgcagaaaattgggttgtaatgatgtttttggtgcagcaatgaatgtttagaagcatatctgagggcccaggaaggtagctggatttctggcgcttgcatttgattccaaactgctttacaaggggatgggagcctgcacttctgctttggagcatggcccatgttgcaggccacctgcagtgggggccactggctgtctccagaggcctttcccacccttctcctccagtcctgatggccgcacttgaagcaggatgcagcctggggccagcagacagagggtttctgatttgtgcaggccgcacttgccccttcgctgaggacgaggaggagtgtgctgccagcctgcctttctcctggctgcccttaccagtgctgtggcttcagctaattgtgtccattccctctctctcaaggtgggggcgggggtgtggggagaggaccagacaggaatgggtgcacctgaatcccccactcccacttcaaccagtgttgttttttgtttgttggtttgttttttgaaagcaagtttatttttattttatttatattattattttttgagacagagttttgctcttgtcacccaggctggagtgcaatggcgcaatctcgactcactgcaacctccgcctcccgggttcaaatgattctcctgcctcagcctcctgaggagccgggattacaggcgcctgccacctcgcccagctaatttttgtattttcagtagagacggggtttcaccatgttggccaggctggtcttgaactcctgacctcaggtgatccacctgtcatggcctcacaaagtgctgggattacaggcgtgagccactgtgcccagcctgaaagcaagtttatttatttatttatttatttatttatttattttgagacggagtctcgctctcgcccagtctggagtgcagtggtgcgatctcggctcactgcaaactccgcctcccgggttcatgccattctcctgcctcagcctcccgagtagctgggactacaggcgcccacctccacgcccagctaatttttttgtatttttagtagagacggggtttcaccgtgttagccaggatggtctcgatctcctgaccttgtgatccgcccgcctcggcctcccaaagtgctgggattacaggcgtgagccaccgcgcccggctagcaagtttattaagaaagtaaaagaatgaaagaatggctactccataggcagaacaactccacttcaaccagttttgagctttgtttttattagttttctacctcgggcttctcacaagatgtcagaacgttctgctgctttacagcagaaatatctttgaaaactgctgtagttgaatcctatagatatgacacccctgttcagtgaacatctgtgtagaggagaagctagaaaacatctagctgtcattgttaggtggttgtatttgggattattttctaaattagaggtgatactctccacaggaagtattactgcagtgtggaatttatttccaccaaaatagtgcccaggcacagccggggctcattttgaccttctacttttgtttttttttttttattgctgcttcaactagcctgggatggtggaactatattgggtatttctttcagcctaagggcaatgtgggggaaaaaaaactgagatgtgaatggcacttgagatactaaggaaacccatgggctaaccccagggaggccagaggacaaagaagccctttgatgaagctcataccggtcagtggcctgggacacagagagtggatctgaagggcagatggcaggcagcaggccttatcctgaatgagcagccaggacccgtgtgggggcactgtgggtgaaacagagcagggtaaaacatgcacctgccctcaaggagattaaagtccagacagacctggaagcaactatacatagtcacatgtatcttaaaagacacacaaggattccattattgctgtagtgctatctgccaagaggacacttgccccctttctcccaggttgaaggccgttgctgtcgcctattgctgcataatgaacctccacacattagtggcttgaaacaactgtttactatgctcttagactccataggttgggaattaggataatgcagcaaggatggctgtctctgctctactgtatctaggacctcagctaggaggactcaaatggctgggggctagaatcatctggaggtttttttttactcacatgtcataaaggatgggcttagctggggctgtccactggaacacccaaatgtggcctctctggtttgagcttccttatagcaaggcaactgtatttgaacttcttacatagccccttcaggttctaagcatgaacattccagtagacaaggtagaaaacagatgggcttagaaaccttttaaaaattgtggtaaaatacacataacatttaccattttaaccattttaaggcacacagttcagtggcattaaatactttttttgtgtgatcatcatcattccccctcccctaacccctggcactggctcatctgcttcctatctggatttgcccattctggacatttcatagcaacggaatcaggtagtatttgtccttttgtgactggcttatttcacttagcatgatattttctgagttcctgcctgttgtagcgtggatcagtactccatttcttcttatggttgaatagtattctattgtacgggtagaccatgttttgcttgtccagccatcagctgatggacatttgggttgtttccaccctttggctattgtgagtagtgctgctgtggacatttgtgcacaagtctttgtttgaacaactgttttcagttctttgggatatatgcctagatcatggtcttttatgacttggccccagaagttaccagcgtgactttcattgaattccataggttatgagtcagttgagggtagtctggattcaaagtgagaacatatatcctacctcttaagggaagagtgtcaaagaattcttagccatcatttaaaactgccgcacaaatctcacatttctgggtcctgctgaaatattgctccctccctggagcgtatcccagttctcctagctgggagtaactacttgtagctctattgtgatggcgacttctctcacctctctagttctttatgaaataatcaccatgaggtatatttgttagtgtccagttagtagcctagctccgtgtgtgcctcttcattttctgttccttcctgtgacgccatgctgctgtcctcagcggtcgggttctctctctctgagcgggggatggatcagctgattctgagagcccttcagcactgatgttctgtgggctccaagtgatcttatttgtacaggctttctccgtgagggaggcctccttctgacagcacagtgcctactgtgtagccttggaggagcttgctgagtgtaggtctcaaggagtttggattaaccctcaaggtggggcagcctggggatttgcccttcttcacctggaagaagagtccctgggggttgagctttatttttttattttatttatttatttatttatttatttatttatttatttctggagacggagttttgctcttgtcacccaggctgaagtgcagtggcgcactctcagctcgctgcaacctccgcctcccgggctcaagcaattctcctgcctcagcctcctgagtagctgcgattacaggcatgcgccaccatgcctggctaatttttgtattaatagtagagacacggtttcaccatattggccaggctgatctccaactcctgacctcagttgatccacccaccttggcctcccaaagtggtgggatcacaggcgtgagccaccacacctggccttcattgtttttttttttttttgacagagtctcactctgtcacctaagttagagtgcggtggcaccatcatggctcaatgctgcctcaagccctgggctcaggggatcttcccacgtcagcctcccacatagctgggaccacaaacatgtgataccatacccaactaattttttaatttatttgtagagacagaatctcaaactcctgggctcaagtgatcctcccgcctcagcctctcaaagtgttgggattacaagcatgagccatggtgcttggcctgagcactctcctagatagactattgagcagagtttttcaaccatggcactgctgacctttggaccagataattgttctgcaagggataaggcgggtgggtgtcctgtgtgttggaggatgtttagcagcatccttggcttctgcccactagatgcgggtagtacacccctccctagtcttgtcaaccaaaaataactccagacattgccgagtgtcccctagggggtggggggtggcgaatcaccccttgttgagaaccacgactgtaaagacggatacagccatgccttgcttaacaatggagagatgttctgagaaatgtcatgtgatctcattgtgtgaacgtcatggagtgtacttacgtaagcatagatggtatagcctactacatgcccctaggctacaaacctgtacagcaatgtgactgtactgaatactgtaggcagttgtaatacaaaggcaagcattcatgcatctaaacatagaaaaggtaatgtgttgtgctaccatgttatgatggctaccatgtcactaagtgataagaataactagggtcccagttacaatcttatggtaccaccatcgtatatgcagcccatcatttggctgaaatatattgctatgtggccacatgactatatattctttgaaatatcgctctgttttcagtattgttcacgagtcactaaagttttctgccatcgtcacattgcccaggacagacatgttggaataagtcaggtctcagccagtcttgtgcattggtatcagctcagacagttctatttttttcttctctacagggcaagttctaagctcaggcaactctaggaacataccttagactccttgatgagctttcaggtcaccctagtgagaccatatgcatcaccaatctgtgtagttagttattttctgcatagatttccacagatggctcgtctcatctcttttatgttcacccttattagtttccattttagatggtgaccttgtcttttttaatgcatttaatgattttctgcgaaccagtgaaaaagaataaacagcaaaatgagccaaaaatttgaccaggcaattcatataggtagaaatcaaattgcacaataaacatataaaaagatgatcagcctcattagtaatcggagagatgcaaattaaactataataagataacattatataccctccggtagactaaaaattgtaataaagtctgacataccaaatgtgtacacaattacaagagtaatacatactcttcgtagtaaacgtgggaaatgtggagaagtgtagagaagacacaaacctcgttacctagggataaccactgttagcatgttagaatacagtatgccaataattttttccatgctgaaatatgtatttcacattattggcatcaaactgtatatagttttcacctgtattgtgaaatataacagatatagaaaaacatgaaaagcctatatgtaaagtttttgttgttgttgttgttgtttttttgttgttgttgtttttttgtagaagtggagtctcactgtgtttcccaggcttgtctgaattcctggcctcaagcaatattcctgtctcagccatatatgtaaagtttaacaaaaatgtataaaatgaaaacctgtgtcaccaccgaccaggtcgagaaatagaatgttgacaacacttgtacagacccctgtgtgcccctcccagtcacagccccctccctccctgtagaggtagacactaccgacttttgtgcggtcattttctccctttactttatactctgccacctatgtatgcagccataaatcatatagttttgttttacctgtcttctaaccttgtagaaatgggatcacaccatgtgtaatctgttttgtctttcccccaacattattgtcgatctgttgtgtgtcactgtagttcatttgttttcgttgctatatgttattccactgtttgactatatcacaagttgttttttaattcattctcttattaatgaacatttggataatttccagtttggggccattttaagtagtgctgccaggagcattcttaggcagatgtgcaaaagtttctctagggcagaggttctcacactgtgctctgaggacccttgtgggggcctatgagacttcttcagggggtctacaaggtccacctacatttattgattgattaattggttgattgagatgggatctcactctgctgcccaggctggagtgcagtggtgcattctcagctcactgcaacctccacttcccgggctcaagtgattgatcctcccccctcagcctccccagtcactgggaccacaggtgcatgccagcatgcctggctaattttttgtatttttggtagagatggggttacaccatgttacccaggctagtcttgaaccccaagctcaagcaatccacccacctcagcttcccaaactgcagggattacaggtgtcagacattgtgcccagcccaactacttatatattaatcctaggatgttaactgcctttcccattctcctctcacgagtatgcagtggcgttttttagaggctatgtgacatgcagtatcatcaccctgatggctaatggagtgtgtgcttgtgtcatatggtttaaaaatgcctgttttaatttctaatatgataaatatcaatagcagtcactgatacaaataaaagctctttgaggtcctcaataattttgagtatatttaaaatctttcaggccaaaaagtttgaaaattgcttctctagggttatacctagaagtgaatttcctgagttatgcagtatttggaacttgagttttatgaggtggtactaaactgtcttccaaaatggttgtaccaatttatattcctaccagcagtgtaaaaaagttgttgtgccagcctcaccagcgcttggtattgtcagacttgactatgatatttagcctactggggctttttataatattgtaatggtttcgtttgcatctttctggttactaatgaggttgaacatcttttcctatgtttatcttccagtttggtttcctcttttatgaattgcctggttgtctttggctcattttcctgtttattctttttctactaatactcactcatgattctttatttcctcgtgtgcttggtggtttacttatttatttatttttttggctgtgtactgcttattgtaactgaaatatatatctggggaatctttgaagtctagggtaaatttgccttcttccagagaagaatttatgtttggtttttgtcaggtgccttgtgtgattagtctgggactaccttaaagtttctaccattttcgctttgttttgccatcatcaaggcagcctttcttgcaatcctctgggggtggaatttgggaggggcatatttgtttctgagtcgcccttgccccaagggtgtaacacgttggggtcccagcttaatatgagaagaattttctgttacattcctttaatggtcatgggcctgctcttcagccccctttgcctgccttggaagattgtcaaaaccaaagtcaaaatttgtccagattggcagatgtcctcagagcctgtggctgcatgtgcatggactcctacctccctggattttccactgtcttttatgggttgtcatggttttttttgtttgtttgttttgtttttgtttttgtttttgagatggagttttgctcttgttgcccaggctggagtgcaatggcgtgatcttggttcactgcaacctccgcctcccggcttcaagcgattctcccggcttcaagtgattttcctgcctcagcctcccgagtagctgggattacaggcatgcaccaccacgcccagctaattttgtatttttagtagggacgggtttcgccatgttggtcaggctggtctcgaactcctgacctcaggtgatccgcccacctcagcctcccaaagtgctaggattacaggcatgagccaccatgcccggcctctcatggttgttttttttaccaacttgtcagttcttcaacacttctaaatgttttaaaatgatattttagaatcaaccattttagttgtttgtaatgggaagattggtccaaataatctattttgccattactagaagcacaaattatattgtgagagtatcttatgtattatagttaaaacatgttttgaatataatttttttttattttttgaggtggagtctggctcttgttgcccagtctggagtgcagtgccatagtcttggctgactgcaacttccgcctcccgggttcaagtgatttctggctaatttttagtatttttagtagagatggggtttcaccatgttggccaggctggtctcgaactcctgacctcaagtgatcagcctcccttggcctcccaaagtgctaggattacaggcgtgagccactgcgtccagcctgaatataatttttgatgaatatttaggttgactctaggtctttgctgttataaatgacatttcattaaatatctttgtacataatatttggatgaacattatttctagttacagggtgggagggagaggcaggagagagagagtctaaaccttggtgctcagttaatgttaactcttgtcactcttattacacgtacacatgggatggctgaagggcacgtggagccatcctgcctaatggccttggtcttttccctggaggaggaaacaaggtcttgtgctgagtatatgaggagccaggtagagagttaagattggaaagagtagtccgggcgcggtggctcacgcctgtaatcccagcactttgggagaccgaggcgggcggatcacaaggtcaagagatcgagaccatcctggccaacatggtgaaaccccgtctctattaaaagtataaaaattagctgggcgtgttggcgggcgcctgtagtcccagctactcaggaggctgaggcaggagaatcgcttgaacccgggaggcggaggttgcagtgagctgagatcatgccattgcactccagcctgggcaacagagcgagacgccgtctcaaaaaaaaaaaaaaaaaaaattggaaagagtactgtcaggtacaaagggagccaattaaggaaatgtggattgccaaggtaccccaagggcctggcttgactcaaacaccctgagctggcacctgtgccggtgctaatcaggacagtgatacaagactttctcctgcaatgtggcaccaccccagaatacagcaaggctggctggtggcgagatcaccattcctggtcagttccctccaagaactgttaattgagtgctgtgtatgcaccaggcatcttgcttggtgctggaccaatggtgatgcgggcactgactgtgtttcaaggagctcctggtccagtggggttgggagagtgggttctcttttcaaagttgaggattggcagggcaggggcagagcattgtgacaggtattgctggctctggctacaatctctgcgatgacctagctgggactgtgccaggtggcaaaggaggtagagcccattgaaggtttgaggaggaccagaaaggattcctgagggtggcctggcaggctctgcaggcctgctggggtataggttgggccacgagtgggaagatagagccaaggccacagagtgggatttccaaggcgggacagtttcttgtccagtgtgggatgaagtgaaatgagagcatgaaggacactggagaggaggaaggaggtcaagggaccaagggcaggatgacttggggtgaagagagaacccagccacagccaggcagctccctctcactcgctctagctccctctcgctaggaggaagggtactggaagtcaggagaggacagcctcaggaagcaggtcaacagccaggtgactgcagccctcaagcattgaagtacattgaagtactgacaagattctaagaacaaccatgacagaacctaggagacaggaaattcagagaggtaactagagagtgagggtgggtttcttggaaggccccaatcttctttttagaagagaaaatagtggtagaaagtcacaaagagacttgccccaagtcacagatgcgtcctttatatccactgcctctaaactacagaaggcttttttgtgtagaggattaatttcctttctcctcccacatgttaaaacagttccattttctttcacacaccatacgatttacctgttaaaatacacagctcggtggtttctagtgtattcaaaactgtgcaaccatcactctcattatctaattttagaacattttattaccctaaaaagaaaccccttaccagcccctcccatttcccaccttccccctggccctcagcagctactaatctgctttcagcctctatggatttccctattctgggcattcatataaatggaatgatataatatctggccttttgtgtctggcttcttttacttagcgtgatattgtcaaggtccatccacgttgtagcatggatcagatattcattcctttttatggtcaaatagtattccattttatgggtagaccacatggtgtttatctgttccccagctgatgaacattcaggttgtttctgctttgcagctgctatgaatggtgctgctgtgaacagttatgtacaggtgtttgtgtggacttatgtttttaattctcttgggtggagttgtgaagtcatatggtaatgctatgtttaactttgtaaggaactgtcagactattttacaaagttgctgtgtcattttacaatcccaccagcagtgtaggaaggttccagtttctctatgtccttgccaacacttgttattttctgtttcatttttattttagtcatcctggtaagtgtgaagtggtaactcatgatgggtttgggtttgatttgcatttccctagtgactaatgaagttgggtgtctttttttttttttttttttttttggagacagggtgttgctctgtcacccaggctggagtgcagtggcaccaacaaggctcactgcagcctctgcctcccaggctcaaccaatcttcccaccttagcctcctgattagctggggctacaggtgtgtaccaccatgccgagcttttttttttttttttttttttttttttagtttttgtagagacagggtttcgccatgttgcccaggctggtcttgaactcctaggctcaattgatccttctgccttggcccccaaagtgctgggattacaagtgtgagccaccacacctggcttgggcatccttttatgtgctcattagatcatgtgttctggagtaaaattctgtttaaggcaaagggcactaaacctggaaccaggaggccctggccataccctgaatcacggtgagtccttcatgtttcttgttagatttatctgttgccaggtacttcatggtatatcattcctttataaatgcatcttcctacttgagagcagggaccttattggtcaaattcaacacttctgctctatgttttcaattgccaccttctcccttttcttaattctttccactcacctaaaaagctaaagttttccttcatccttcaacatctctctttcctctgcctcccttttaataagctagtatcttatctcctttctcctttaggtctccactccctacctttctacctcatctgccttcaattctcagtcaaactggagtgtgacttctgtcatcttcccctcttgtctactggaaggtttctctacggccaccagggtacctgtattttttaggttgattattgaagtagcaggtcccaaatcattgataccagtgacctctctgatgagtggaattggaaggaaggggtgacctcactccttgctgtagagttgttatttgggagaatgtatataagaaagtccttaaattagcttgatagagagcaggcaatggtagcaatgtggcatagaactgcttatttagagttggtagcaggaaatgtctacattagtgatatccaaataatggaccccaatgacctttgaattgatattggggtcaagcattgaatgtaaacagttaatgatgagctgggtcatatgtgtactgcaatttaaaaaatgtatttaaatgttgctttgattaataaattgcagaaattttagaatctgataggggcaggcctttaaaaaattactcttgttttgaaatttatcttcccatgcattttattcacatatactttagagtcaagtttttaaaaaaagtccgttgggattccgattgcacttgcattgactaggtgagagtcttaggaaaatcaacatttttttccttttttttttcttttctttccttcttttttttttttagtagtattaagttttcctattcaaattcaaggtctctctatatttagttctgttgtctttgtgttttatgacttttttcaagtttatttttcacattgcttgtcagacttattctcaagtgctctgtagtatatattcctgttgtgaatgggacatttttcccccatggtgttttctttccctttttttttttttagacagagttttgcccttgttgcccaggctggagtgcagtggtatgatcttggctcactgcagcctccgcctcccgggttcaagtgattatcctgtctcagcctcctgagtagctgggattacaggcatgtgccaccatgcccagctaatttttgtatttttagtagagacagggtttcaccatgttggccaggctggtcttgaactcttgacctcaggtgatctgcctgcctcagcctcccaaagtgctgggattacaagcgtgagccactgcacctggccccctactatgttctctaagtgaggattgttggtgtctgagaaagctactggtgtgtgtgtgtgtgtgtgtgtgtgtgtgtgtgtgtgtgtgtgtgtatgtgtttgagataaggtcttactctgttacccagcctggagtgcctagcattcttcgttagccactttacctaacaatctttttatttttatttctcctagttttattgttttgtgtatttttagtgttgttttctttttttgagacgtggactcactgttgcccaggctggaatgcagtggtgcgatcacagctcactgcagcctcaaactcctggcctcaagcagttcttctgccgtagcctcctgagtagctgggactacaggcacatgccaccacacctggctaatttttaaattttatgtagaaacgggctcttgttatgcccaagctggtcttaaactcctggcctcaagcaatcctcctgcctcagtctttcaaagtgctgggcttacaggtatgagccaccatgcctggcctttcctagttttgctcttgattctgttggcatttccaggtatataaccatattatctgcaaatagtgatgactttcctcttccaatatttttccctttataatcacttatctggttctcttatctgattctactggctattaaataatagtggtgctaatagtctctttgcttgttcttgactttagtttgtgatatgtatttttatcacattaaggataaatcctgactcctatttttactaaggatttgtctttttaaaaaatcagaattggatgccaaattttatcaagtggtcctttggtgtctcccaaggtctctctgcttctatttaacctgttaatgtagtaaattctatcaatagtttttctgtatatttatgacttttttgtttctttctttcttttttttttttttttattaagagacagggtctcgctatgttgtccatgctggtttcgatcacttgggctcaagcagtcctcctgcattggcctcccaaagtactgggaatataggcatgagccaccatgcctgacctagatatgatttttatatcagtatttaaaagtgagattagactgtagtatagtttttctgtactaccttttccagctgttactaaaagaaatgggcagtttttcttatttctctgctctggaaaattggaacaggagagaaattatctgtcttttgaggactgacataattcttttgtggactgagcctaggttgattcttttaaagaggtaattcaaagacaactttcctgttcttccccgtggcattttctctgtttagatttttgtctttcttcctgactaaattttgaaaatgtgtgtatttctatgatgataaccatttcatctagttgaatataagtttcataaaggcaggatttaaaaaatctgttttgttcactgttatattcccaggacctagaacaggataaggcacatgctaggtgttggtagatatttgtcaaataaatgaaagaggtaatcaataaataaagctagatttttcccattcatgagaatggagctgtataaagctttgtcttaccattattttgatttgttttgtattagtagttactattttctcattcctaatttatgtcagccctttttttccttgattaagttagtgaggtgatctcttttggtgaacatttttaaaagaaactaggcagaaggagcaaatcacctattagaagaaaagaactcaggttcacttcacccttcttcgtgacaatatttgatgccagaagaaattggggtaatgcctctactaacttagagggcaaaagtgtgtgatctaagttgtcattctcatggagaggcaacacaaaagcattctgaaaaatgtaaggcttcctgtacacacatgttcataacagctttattcctaattgccaaacactggaatcagcccacatgtctcataccatggaatacaactcagtaataaaaaagaacaaactattgacaccacaacaacctggatggatctcaaatgcatcatgcgacatgaacaaaggcagtcttagaagaattctgtattagtctgttttcatgctgctgataaagacatacctgagactgggcaatttacaaaagaaagaggtttaatggacttacaattccacgtggctggagaggcctcacatcagggcagaaggcaaggaggagcaagtcacatcttacatggatggtggcaggcaaagagagagcttgtgcagggaaactctttctcataaaactgtcagatcttgtgagacttactcaccatcatgagaacagcacagaaaagacctgccccaatgattcagttacctcccaccaggtccctcccacatcacatgggaattcaagatgagatttgggtggggacacagccaaaccatatcaaacacatactgcatgattctaatgtgacattcttggagtaacactattatagagatggagaacagagtagtggttttcaggggttagggacaggtgtgggggaaagaggaggtgggagagaggtaggtactcttataaaagggcagtacaggggatccttatggggattaaacttgttctttatcttgactatggtggtggttacatgactcactcatgtgaaaagttgtatagaacttaatgaacacgcacaaatgagtgcaagtaaaactggggaaattctgaatacgatgtgtggttatatcaatgtcagcatcctgattgtgatagtgcactataattttgcatagtgtgatatttgtgtaaagtaaactgagctaagtgtacaagggatctctttgtattatttcttatacctgtctgtgaatctgtaattatctcaataaaaatttcaattaaataatataatgctttaggaattacatgtcactcagcaaccctcctggagacatctacttaatagtataaaacagccaagcaagagggttgtactcagaaaaggggaggccaagggaggaaagaggtggcagtaaacactgaagtatttaaacagatctcaatgtaattgatcagatagagagagatgcctggcaggaaggcctgggttcagagcttgggagccactctgagtgtggggacctagtttgtggaggggagctaaaataaaaactaaaatcataggaacaggtggaatcagtctgggagaatgggggaacatgaaagatttctgtctttctggggaacaccgaaattgaagagctagacagagccagatcagtgaaggccaccaagtaggagtgatgagtgagataggacaagattcagaggaggaaaatgttgcagaggtttaggacaaagtgtttcaaggaaggttgcccagtgacatcaaagccagtagaggagtcagaagaatgaggcctcaagcctgccaggtgcaaacctgggtgtggcatttctcctgaaggctccctctcctgcgatacttcccccgcccccgcccccgccccccatttggtggatggtgccatccttctagcctgtaggctaggggacacatgtaggtcatctcagaaccctcttactcctgcagcccctctgaactcttcccactggcctttctcacctgccttcctcttttcctgtggctgttccttgccacacactctgttcccactctcccaattccttcttcctcactagcatcttcctattctgagaatgatgggctactaaaccactaagacctgactcaggaggtttcctctgcctgaaggccatctccctctgctcccagagaatggctgctcacgtctctgagcctagctccaatgctacctactccctaaaagcctgcaggcagagctagtggctgctgctggcatcaggtagcacctcacgtgtgaggctctcatagccccatttgtttaaatgtctctgccactagaccgaggccaagaactctggttttctaatctttctgtctcctctagtacctggtactccataggtctttggtttatggtgactaaatggtcccatgctaacttcctggttctataaccctatgaaaagcattcactgcaggatttcctttgaaatgaaagctccttaggtcattggaaataggattgaatttgcagaaacttgaatcacagcagcaggttcagaacttgtgttcaagcagggcaccctggtccctggaaggtacatcctgtttcatgtttgggtagtcaggctcaggccctggttggaggccaggtgtatttatagtgagccaggcatgtgactcatctcttccccatctcatgctctgggtgcttggctccttctcattcctcttctcccttcctgttatgcagaccagcctcagttttagatggtagactccaacccgattccctgcagtgtctcactagaatcatctttatgctaccttccctgtgaatgtaggatcctgaaatggacttttcattttttatggctttaaaaaaattgagatataattcacatcccatacaattgaccattttaaagtgtgcaattcaatggcatttagtgcgttcacaaggctgtgcgtctctcaccagctctgaaacactttcatcactgcaaaaagagaccctgtatctattaagcagtcactccatatttgtcccacctcacaaccctgggcaaccacgaatttacttctagtctgtatggatttgcctattctggacatttcttgtaagtggactcataccgtatgtggctttttgcaactgactcgtttcacttagcatcatgttttcaaggcttatccaggttgtagcatggatcaatgcgtctttgttcctttttgtggctggattatattccactacatggatgtacctctcccactagaactctgctctgtgaggtcgtcagctgcagccacctcattcgaggatgtttctcagggctgaaatgagagctgggcacctgttcatgctcgtcggtaaccagctgttggataaatgagtagaggctgctggttttttcccagtgtctggtaatgctcggtgatattcctcaatggagagctggctgggaggatgggagtggacacaggtggagggggaaggctgcatgctggagctgtaggtggtgagtgaccaggttggggccaactgaacagggactgcttcttggtgccaggcctgctcaggccactggcccatcctctactgtttgctgagctttgctccttcccatacctttccttgttcctatttgcattttaaacactgtcctatttagaaattaacagagggagaattgatgtctttttgatattgggtccccttatcctcaacctagtgtgtcttttcatttgctcaagtcttcttttgtgttcttcagtagtgggggatttttttttttttaactgctccttgcagagcagggctgccttataggcagtgtgcccagagtagccttcagtagtgttttaaatatttttccactcgtatctagtatagttcttaagtttttttttttttttaacatattgaggtataatttacacacaggaaaactttctgatattaagatcttcagtagtcatctttggtagtgttttaaaattttgttgctcagttctggtatgtttcctaaacatttttttaatgaggtataattcacatacagtaaaatgctaacatattaagatctttaagttcagtcagtttcaatgagtgcatatcaagacagaacattttctgtcacccccagaatgttccctcatagcacttccccaccttgcccccagcaaccactgatctgtttatgagtgtttttttgtttgtttttgtttgagacagggtctcactctgtcacccaggctagagtacagtggcacaatcacagctcactgcagccttgacctcccgggctccagcaatccttccacctcagactcccaagtagctgggaccataggcatgtaccaccatgactggctgatttttaacttttttgtagagacagggtctccctacattgcccaggcttgtcttgaactcctgggctcaagtgattctcttatctcagcctcctgaagtgctgggatgacaggtgagccgttgtgcccagcctgatctgatttttataccataggttaattttatctcttctagaatttcatagaattgaaactatagattatttccttttttgtttctagctctttcatgcagcataatgttttcaagattcagccgtactgtatgtgtcagcattccttttcactgctgaacagttttccattatgtgcatctattctatttatctattctcctattgatggacacttgggttattttcactttagagctattacaaatcaagctgctgcgaatatttgtgtccaaggctttttggggatatgttttcatttctcttggatggaacctaggagtgagattgctgactcatggggtgtgaagatgtttaactttttctaagaaacagttagagttttccaaagtggttgtaccattttctactcctaccagcagtatatgagttccagttcctctgcaccatatccaatatttgctggtgttcggctcctccagctttgatttttctgtcattccaatcttatcaaccttcagtctgaatctgtggatgccctccctacctgcctcgtgtttctagtgctttcatgaatgtatttgcttgtaggctgcttttctgatattttccaggggttttgagagatagaggatataaatatgagtgcttgagcaagaggtcagagcctgtttttagttatgtgagtaatctctggtgtggggttacagcttgaggttgaaggtaaaaaaaaggaccaactgttcccctgtcttgtcattttcctcctttctgcattttcaaagcagcaaatagcaaaaatgatttctgtgtcttctaagccttctgataaaggaatattaaccttttggcccaagccttactgcacatccaagaataagttatttaaaaggaaatgggactgtcgacatttcccacaattttaaatgttaaaaatccttttgtgtgtgggaggcatagggattgtttcgctagttcctgtagatgctcagccctcagccagcgtgccagatgggtgcgagtgctcccgtcactcctcgcattccccctcttctcaggagtgtatgtgcacagttctgcttgtcccttatacaggaaaataactgcttgctgccttttcttccctcctggagcaaggcggactctcccaagagagttagggattctggggctgctaggatgggggggtgcagtgcagtggggtgagacagtggctctggctgtcccagcccctgttaaaggaggggtgtaggaggtggagcctttctggtggcagcagttcctgagcctgggaggagggaggaatatgtgatgaggacatcctttgtgaccaggcattaaaacattgaatatgaaacctgtagttctggggtttgatgcattgattagtatgatacctccacagagcaggatgacaaatttgcaacctctgcctcactggctaagcaattcttctgcttcagcctcctgagaagctgggattacaggcacatgccacaatgcccggctcatttttgtacggactgcttcctggcagtttagtaccatgaaggcattgtgacttgtttactccagcctctggaagtatggcttaaaatctgtgcactctgtaattcgtccgcctgtctttggctgtctgttagtccatcagagctgtgttgcacggaacataaacatgctttcacagaggaacatgccagcctgggagggaagcccaggcagtaggcttgctgacttttaatatctcctttaagcagaatttagcatagccagagagggtggggttggggtgggcagagcagggaagaaacctaattatgcaaattttgatcttaaagctttattcgtatgtttcctggcaggctgttctttaatctcaagagcaagattgctcagaattaccatatattctagttaattgcattaaaattatagcaaaggttgtttttgctataatcaagagtgattctgattaatacttatgaaatcaaatgcctcaccagcagtggggatgagaacaaccttgccagtcagctattccctccccagtcttccctccccagtctcccctccccatcttcctccaaaaggccaaagatacaaacatgtttgaaagagtttttttttaaaactacttgcttatatggatagtcattttcaaagaacacttctcaaagagggagtctgattattttcttctctctttagtacaaaggttgtaaaatagctctttattgaggaaggcaaagagagggcctgagcagacgccttggctggcaacagtgacacaagcacatgccgtcctctcctgactggctagctgtggactggcagccactcagggcactctgaagggtgttttctgtcagatcagtagagcaccttgggaagatccagaagaaatctggagaagacacaatcacacacataccgaaaacattagaattacatacaaatatgagatagaaacaaagtggaaatgaactagagtaaggtatgtccaaagtgcttagtggagggaccagggtgatggcagtgggcctgaaggaaatgactggatgcaagagggatttgttaggtcgaattgactggcctcattgatgggtcggatgtgggtggtgaggggaaggagttgtcatgggtaatgcccaagtttctggcttgaggagcagtggtgccatttcctcagatggcaatggtttgtacaggtctccctgcacacatgggagttagatgctgagaagttaacttacaaggtgagatttccaggaggttcctttggaggttcttaggctggatacagaacctagacattcctactagtgatgagagaacagactcacaaggagaggcatttcacagggaccatcatcgggacaagctcattttcagaaaatactaaacttattatccaggaaagtctcattcacttgccttgaccatgagagaaactattgaagagcagagaatttggcagattgcaaaagagaacatcacagaaatctgatccagcatcatagtcatctttgtttattgatcctcatgtgtgtaactcagttttaatcatcttctgccacgaggccatcacaagtatgcttccatggattctattcaaaggattggagtcttcacaggaaaccacctacatccctgagcctctgtcctcttaaaacccaggctgatagcaacagaaagtgaaacaccacatgttctcactcatatatggaagctaaataaagttaatctcatagaagtaaaaagtggattcgaggatactagaggctgggaaggctagggggaagggggcagttaggaagagattttgtaaaggatacaaaattacagctagataggaagaataagtctagtgttctatactattaggatgactacagttaacaagaatatatgtttcttgtgtatgtgtgtgacaagagtctcactgtgtcacccaggctggagtacagagatcttggctcactgcaacctctgcctcccaggctaagcgattcttctgcttcaacctcccgagtagctgggattacaggcatgtgccaccatgcccagctaatttttgtagttttagtagaggtggggtttcaccatgttggccaggctggtctcgagctcctgatctcaagtgatctgcccgccttggcctctcaaactgttgggattataggcgtgagccactgtacccagccaagaatatatggttttaaatagccagaaggaggatattgaatgttaccaacatgaagaaatgataaatgtttgaaatgatggatacgctaattacactaatgtgggcaccatacaatatattattattattattattattattattattattattattatttttgagatggagtctcactctgtcgcctaggctggagtgcaatggcacaatctctgctgactgcaagctccgcctccctggctcaagctgttttcctgcctcagcctcccaagtagctgggattacaggcatgtgctaccacgcccagctaatttttgtaggttttttttttttttttttttttttttttttgagacagagtctcactctgtcgcccaggctggagtgcagtggcacgatctcggctcactacaacctccacctcccgggttcaagcgattctcctgcctcagcctcccgagtagctgggattataggcacatgccaccacgcccagctagttttttgtatttttagtagagacggggtttcaccgtgttagccaggatggtcttgatctcctgaccttgtgatccccccgtctcggcctcccaaagtgctgggattaaaggcgtgagccaccgtgcccagccatgtagttttattagagacagggtttcaccatgttggccaggctggtctcgaactcctgacctcaggtgatccgccctccttggcctcccaaagtgctgggattacaggcgtgagccaccgcacctggcccacattatgttattatatgtatcagtacatcactatatgcctcatgaatatgtactacagttaattattttgagacaaggtctcagtctgttgcccaagctggagcgcagtaggggagatctcagctcactacaacctttgcttcccaagctcaagtgatcctcctgcctcagcctcccaagtagctgaaactacaggcgtgtccccccacacctggctaatttttgtatttttggtacagacagggttttgccacgtagcccaagctagtcttgaactcctggactcgagtgatctgcctgccccatcctcccaaagtgctggaattacaggtgtgagccaccacctccagccatgtacaactattatttgtcaattaaaaaataaaagtaaaaaaggaatgtcttcagtaaacatacagtaattaggaaagtttttgcacatttggaaaaactagaaaacaaaaaaaacaggctgatgagtaggatgaaataggtcccaggagctacctgttttttttttcttttgatttttaaattttagaacattttggatttatagaaaaattgtgaaaatagcagagtcttctcatgtgctacacacccagtttcccctgttcaaaaacctgtataaaaattgatgtatcattgtacatattgtaggggtacctgtgatactctgatacatgtatatcatgtgtaatgatcaaatcaaggtaattagaatagccaccacctcatacatttatcatttctttgtgttgagcacattataattcttctcatctagctattttgaaatatacaataaattcttgttaactagagtcactctactgtgttatataatagtagaacttaatctttctaactatatttttgcactcattttaaagtttaatttttttttttaatagagacagggtcttgttattttgcttaggctgttcttgaactcctgtcctcaagcaatccttctgccttggcctcccaaagtattgagattacaggcatgagccactgcacccagcgtttttgtacccattatctgacctctttatccctctcttattattgacattgcaaattagtatagtacatttatcacaatcaataaatcagtattgatacactgttattaaagtccatgttttattcagaattccttagttttttcctggtgtgtttttttttgttgttgttccaggatcccatcccctacctgggcattttgcatctgagaattgctgggctgaatggtcaagaattccaagagcacagttccccatgtctttgggttctctgcaggctgatagttgaaggattcctaaaattggttttttattttgttttgttttttgagacagggtctcactctgttgcccaggctggagtgcagtggcacaatcacggctcaccacagcctccaccacccctgggcttaagcgattctcccacttcagcctccagagtagcacggactacaggagtgcatcaccacgcccagccaatttttgtatttattgtagagatgggttttcactacgttggccaggctggtctcgaacttctgggctcaagcaatcctcccatctcggcctcccaaagtgttgggatgacaggtgggagccaccacacctggccccctaaattaggtttttaaaaataccactacccaaacttcagtttagttttcatcttctttttcctgttgctattgcatctgatggagtttaaggtgactcaatgattccatttccaagtaggtccatggaaaagtgtgttgttgctggggatggggagagtcaccacttcctgaaggcctcctgtgcagtcactgtgatgggccaggccctgtttggcatcctagtctaaccctcttggctctctgatgcagaaagtggagttcatctcacatctcaggtcaccatggaaggtgtgcaagacccctctcttattttaaacattatttatttatctatctatttatccatctgtgtagtctatctaatttgtcagtcaatcagtcatagctcactgcagccttgaactcctgggctcaagcagtcctcctgtctgagcctctcgagtagctagaattacaggcatacccccaccctgccatgcctggctaatttttaaatttttatagagatggaatctcactatgttgcccaggccggtctcaaactcttggcctcaagagatcctccctcctgggcctcccaaagtgttacgattataggcatgtaccaccatgcctggccttactttggcttgtattacattatattcccctttatcctccatctatactttccccccctctcctcattaagcaccactctttttttcctcccaattttctcctgtggtgaaatacacatatgtaaaatttaattttttttttttttttgagacagggtctcgctctgtctcccaggctggaagtacagtagcatgatcttgaccaaatgcagcctctgcctcctgggctcaagcgattctcctgcctctgcttttccagtagctgggaccacaggtgtgcaccaccacatccagctaatttttatattttttacagggatggggtttcatgttgcccaggcaggtaaatttgctatcttaagtttttaagtctacaattccatggtattaagtacattcacatggttgtgaagcacctgttctttatatgtcattaaatatgcacatatccttgtgaaatatgtagagtgcatgtgtgctttttatgaatagtattgtgctgatctgtttcctactgtctgcactcagaaccgtgttttcaagatctcttcgtgttgctatatctgctttgttgcttccaattgtcctagggtgtgacacccaaagtgtctccagttccctgttccacagtcagtgcagcagcaagcatccttctccatgtgcccaggagcagaatatcacatcatggggcacaccccaagtgctgccaggtggcttctaggatgactgctggttcatactcccaccaatagggcccatgggcttccatatttccacatccttcccaaatccattcatcttttgaatttttgccttcatggtagatgtgaaaagtatctcgtgctaagcagctgtgataaaggttgcatatctgcagtgtcatgcacggtgctttgtgcacgtgtggatgccttgttatcttctggcctgggagggaatctttagtttggtcagatgaagatgtcatttgttacctgccatcctccttcccaagctgtgttcttcctcctttaagaaccttctctcaagctcctagcttccaggaagcctgtcagattaacttacctactctactccttactcttgattattctagaatacttaggtaatgtgtgcttgtacagctttcctagggctgctgtaacaaagtatcacaaactgggtggctgaaaacaacagaaatgtattgtctcccaactctggaggctagaagtctgagatcaaggtgttgggagggccattctctccctgaaggctctaagtagaagaatcttgtctctccctgctgctggtggtggccatcagtccctggcatccctcagcttgcagctgcatcactctaatctctgtgtctccatcttcacatggaattctctcctgagtctgtttccaagtttgtgtcttcttataagaacacctcttgttggattagggcccacttatccattataacctcagcttaacttgactatatctgcaaagatcattcatccaaataagatcacattcatagattttggttgggtatgaatttgggaggacactattcaacccagtacagtgatacaggcagatttcactgcagcaagtagaatcatacatacaaacaaacaagcaaacaaacaaacaaaaaaacaccaaaagaaaggctgctcatgccccaatcatgagccagcctggaagtttatgtggctgctcctcttggagccattgctacaagatccacatggaaagtggaacagatggcaaatgaattcttgttccttgagttgctgcctttgattgctttgtgctttagtcttctcatctgaaaataggagtgtgatcatcctacctttacatgactagtgcaataatttacaagaatagcaaattaagttccttgtggacagagttgatccctactggaagcccctccctatggtttgggttccagtgaccaaaagatgttttcctcaggtaaataaaaggctctggtggttggactgccattgtttgtcaccttacctcacacaaatgccctgcaagaacaataagaacagaaccatggtgtaatgttcataaatgccaacttgtagcaaaggcataataacatactaaggtgtgaattgtgggccataattaaggcctttgtctgtcatattgcccaattagaatatacgtaattgtaagtagggtcactcttttaagaataagtgattgttgaaaatgtgacgttaaaggtttagcagaacaggatatagaatgaattccaaatggatactgcaaatctgttaagaacaaagttgggcacctggttggtggatttctttttcttttcttttctttctttctttttctttctttctttctctctctgtctctctctctctctctctttctctttctttccttctttctttcgcacctggtttcttttaaatagatgacaactgctgtgtccatttctctggggcaggggatgtaatgttcatgctattccccaggcccaggatggtggctggcatatagtagagctcagcaaaggcttgttgacagaacagattaacacatacatagaagaaagggaccagcagtctcctagggctgctataacaaatcacatacaggcttaaagcaacacccatatattcgcttgcattctggaggttaaaaggctgacaagggtctcactggctaaactcaaggtgtcagcatggctgtgctccttttggaggctctgagagtgaatccattccttgcattttccagtgtctggagacctggagactgcctgcgttccttggcttggacccacattactctgatgacactgactctggccctccctcatccctgttttacttatagggacccttgtgattaccttgggcccacccaggtaatccagagtaatctctccatctcaggatccttaatcacatctggcagtcacttttgccacataaagtgacaagagtcacaggctctgggggttagaatgggaatgtccttgagaaattctgcctaccacaggggtattggatgctattacctttgtattatatcacagtgcttttaaagatagttttattgcttttaaatataaacataataagttctcaggaaataagaaaatagacctcatctatggacaactaccattattgctcaatttcaaaacttgttattgggattcagcttcttcctggtttagtcttaggagggtgtatgtgtccaggaatttatccatttcttctagattttctagtttatttgcgtagaggtgtttatagtactctctctctctctctctctttttttttttttgagaaagagtctcgctctgttgcccaggctggagtacagtggagtgatctcagctcactgaaacctctgcatcccaggttcaagctattctcctgcctcagcctcccgagtagctgagattacaggcgcccgccactacgcccagctaattttttgtatttttttttagtagagacggggtttcaccatgttggccaggctggtctcgaactcctgaccttgtgattcgcctgcctcagcctcccaaagtgctgggattacaggcgtgagccactgcgcccagctaggtgtttatagtattctctgatggtagtttgtatttctgtgagatcagtggtgatatcccctttatcattttttattacccagcaccatttattaaagagactatcctttccccagtccatgttcttggtgccttcatcaaaaatcagctggctgtaaatatgtggatttatttctgtgtatctattctgttccattggtctacgtgtctgtttttacaccaataccatgctgttttggttaccatagccttgtaatatattttgaagtcagatagtgtaatatctccagctttattctttttgctcaggattgctttggctatttgggctccttgttggtttcatacaaattttcggattgttttttctatttctgtgaaaaatggcattggtattttgatagcaattacattgaatctgtatattgctttaggcagtatggtcatcttaatgatactcttttttttttttttttttgagacagagtctcactctgtcacccaggctggaatgcagtggtgcggtctcggctcactgcaatctccgcctcctgggttcacgccattctcctccctcagcctcccgagtagctgggactacaggtgcctgccaccacacccggctaattttttgtgttttatagtagagacagggtttcaccgtgttggccaggatggtcttgatctcctgacctcgtgatccacccgcctcccaaagtgctgggattacaggcatgagccaccgcgcctggccaatgatattcattttttcagtccatgagcatggaatgtctttccatttgtttgtgtactcttcagtttctttcatcagtgttttgtagtttttcttttagagatctttcacctccttggttaaatttattttactttttttggtaactattgcaaatagaattaccttcttgatttcttttttggttgtttcattatttgtgtatagaaatgctactgatttttgtgtgttgatttttgtatcttgagactttactgaatatatcagctttaaaagttgttttggtaaagtttttcagtgtttctaaatgtaagatatgtcatctgcaaagaggaacaatttggctttctcttttccaatatagatgccttttatttctttctgtagcctgatttttctgactagaacttccagtactatgttgaatagaagtggtaaaagtggccacctttgtcttgttccagttcttagaggaaatgctttcagcctttcctcgttcaatatgatgttagctgtgggtttgtcaatatggctgttagtattttgaacgtatgtttcttctatgcctagtttgagtttttacccatgaagggatattgcatttaataaatgctttttctatgtctattgaaatgatcgtgtggtttttgttcttcattttgttgatgtatcacatttattgacttgtgtgtgttaaacaatccttgtgtccctggtataaattccacttgatcgtggtgtattatttttttgatgtgctatttaattcagtttgctattattttgttgaggattttgtatctttgttcatcagggatattggcctgtagttttctttttgtattgtgtcctttactgattttggtatcagggtagtgctggcctcatagaataagttagggagaatttccttctcctcaattttttggaatagtttgtggaggattactgttagttcttttttatatgtcttttagaattctgtagtgaatctatcctgtcctgggcttttctctgttgggagactttttattattttattattattatttaagacagagttttgctgccgggcgcggtggcttacacctgtaatcccagcactttgggaggctgaggcaggtggatcacctgaggtcaggagttcaagaccagcctggccaacatggtgaaaccccgtctgtactaaaaatacaaaaaattagctgggcgtggtggcaggtgcctgtaatcccagctacttgggaggctgaggcaggagaatagcctaaacctggaaggcggagattgtagtgagctgagatcacgtcactgcattccagcccgggcaacaagagcaaaagtccatctcaaaaaaaaaaaaaaagagacagagtttcgctgttgttgcctgggctggagtgcaatggcgcgatctcggctcactgcaatctccccctctcgggttcaagcgattcccctgcctcagcctcccgagtagttgggattatagctgcgtgccaccatgcctggctaatttttatatttttagtagagacggggtttcaccatcttggccaggctggtctcaaactcctgacctcatgatccacctgcctcggcctcccaaagtgctgggattacaggcgtgagccaccgcacctggctgagactttttattattgatttactctcattactcgttattggtctgtccagattttctatttcttcctgattcaatcttggtaggttgtagtttctagaaatttatccatttcctctaggttttccagtttgttagtgtatagttgttcataatagtctctgataatcttttgtatttctgtggcatcaattgtaatgtcccctttttcagttctgattttgtttacttgggtcttctctcttcttcttggttagcctagctattttggttagcctagcaaaattggtttatcaattttgtttctttttaaggaaccaactttttgtttcattgattctttgtattttaatctctgtttcatttagttctgctctgatctttctttctttccttctactaattttgggtttggattattcttttctagttccttgaggtgtattgttagactaattatttgaaatctttctactttttgatgtaggtgtttattgccataaatgtcccttttaatactgcttttgctgtattccacaggttttggtatgttgtgtttcaattttcatttgtttcaagagttttttgatttctctcttaacttcttcattgacccattggttagtcaggagcatattgtttaatttgcaggcattggcatagtttccaaagttcttcttgttattgatttctagttttattccattgtggtctgagaagatatttgatatgatttaattttaaaaagattcactgacttgttttgtggtctgccttgcagaatgttccacatgctgatgagaagaatgtgcattctgctgttgttagataaagtcttctgtaaatgtctattaggtccatctgatctaaagtccagtttaaatccaatttttattttgttgattttctgtctagatgatctaacactgagagtggagtgttgaagtcctccaccattatcgtatttgagtctctctctgtctgtccctctctttagaggtagtaatatttgctttttgaatctgggtgctccagtgttatatgcatatatatttagaattgttatttcttcttgctgaattaatccctttatcattatacaatgaccttctttgtctttttaaaattatttttgccttaaagtccatttaactgatataagtttacctcatgtaactatagctacttctgcttacttttggattccatttgcatggaatatctttttccacccctttactttcagtctatatgtatctttacaggtaaagtgcacttcttataggcagcacatagttggatcatgttttttaatccatcagccagtctatattttttaaagtggagaatttaatctatttacattcaaggttattattgatatctgaggtttcatctctgtcagatttttaattgctttctagttgttttgtatgttgtttgtccttttcttctcttattgtttgccattgtggtttggtggctatctgtagtggtaccatttgagtcctttgtctttctcatttgtgtgtttgctttaccattgagttttctacttttgtacgttttcatgattgtaaatgttgtcctttcactttcaggtttaggactcccttgagcatttcttattagaccagtctcgtgtcgatgaataccctctgcttttgcttctctgggaaggactttatttctccttcattttatgaagaatgattttgatggatagtatccttggatggcagatttttttttttctttcagcattttgaacatatcgtgccattctctcctggcctgtaattttactgctgttagtctgatgggggttcctttataggtgattagatgcttttctcttgctgtttttatgggttgctctttaaatttgacctcagacattctgattataatgtgccattgaaaagacctttttgcatcatatttgtttggggatcactggacctcctggatctggatgtctatattccctgctaggcatgggaagttttcatctattattttattagtttttcaaccccttacattctctcttcgccttctgagataatgataatttgtaaatttggtcactttatgatttcccatatattatgaaggctttgctcattcttttttttatcttttttctttatttttgtccaactgggttatctcaaaagacctgtcttccagttctgagattctttcttctgtttgagctagtctattgttgaagcttttgaatgtattttgtcattctttcaatgaattcttcacttccagaatttctgtttagttcatttttatatctgtctctgtggtaaatttctcatttatatcctgaattgtcttactgatttctttgttttgatttttggaattcttttgtatctcactgaacttctttagaatcaatgatttgaattctttttctgggatttcatgaatttcttttttattggggtttctttttggagaattatggtattcctttggcgtgtcatacttccttgcattttcatgttttctgtgtctttacattgatgtctgatctgttttctctcactatagtttgttttctagagttttatagaaatgggatcacacagcgtgtagtctttattattattattattattattattattattttagcctggcttctgtcactcagcataattattctgagattcattcatgtcattttgtatgtccatcattcatttcttttcctctcagatgaggaaagcctcctctggaacattttggtgttactgaaaaatgctgggccaggtgacttcatgtaacaagcatgctgagtgcccagtcggcatgtggtacacctggccttgccttaggtgctgtggcctcaagcctctcagacctccgttctgtagagaagttagccatgaatggaagttagaatattctgtttgccaagaaccaccacaggaatgtggtgtgatacacaggaggaaattgtcctctgtctggtggggtgggctgaggcttcctagaggatatgatgttcaatttaggcaataactatccttgggcataaaatacaaagaaggacgcttcagacccaggaaatggcagatgccaaagtgtgggcaaggtttgtccttcagggaatcaccacagccagggcatacagaatgtgtgcagtggggaatgatagggaagaatttaaaagtggcaggtcagggccagactggggagggacttgtgtgccaggcccatgaatttggatttaagtgactgtatgagtttcctggggctgccattacaatgtaccacaaatgatgtgattcaaaacaacaaagatgcattctcccacagttctggagcctagaattcagagatcaaggtgttagcagggcacaatccctctgatagctgtatgggagggtcctttcttgcccccgttagctgctggtagcgatccttggtgttccttggcctgcagctacatcacttcaatctctgcctccatgttcacatggagttctcccttgtgtgcctctatcttttgctcttcttataaggacaccagtgatatggtttggatttgtgtcctcagtcaaatctcatgtctcattgtgatcctcagcattggaggagggacctggtaagaggtgatttgatcatggggacggatttccccctcattgttctcatgatagtgagtgagttatcacgagatctcatggtttaaaagtgtgtggcacttcccccctcacagtctctctcctgctccaccatgtgaagatgtgcctgcttcccctttacctaccaccatgactgtaagtttcctgaggcctccccagccatgcttcctgcatagcctatggaactgtgaatcaatttaacctcttttcttcataaattatgtagtctcaggtagttctttatagcaaggcaagaatggactaatacaaccagccacactggatatgggacccactccactccagtatgacctcaccttaactcattacatctgtagtgaccctatttccaaataaagtcacattcacaggtaccaggtgttcagatttgaacatttccttctgggagacacagtacaaaccacagcaataaccagtcatgcaccagtcagtagtgattgtgcatggcagcaggtgttacttccatcttacatatggagagcacagagcagcaaagtcacttcctcacgattgctcaggttcctggcagagaggcagatgtcttctttaggccatctgtctgtttccatgggtcccctttcctcccttattgtaccagctgcagtgaaccaccggggggagggggggcagcaggcagccacagggagccatgaaggctatgttagtttcctagagctactgtcatgaaatgccacataatcgggggcctctgcagcaggtatgtataatctcatgattctggaggctggaaatctgaggtcaaggtgttggcagggttggttccttctgagggttgtgagacagaatctgttccaggccgctcttctgagcttatcagtatccatcttctctctgtgtctcttcacattgtcttctctctctgtgtgcgtctgtgttcaaatgcccaagatagcagtcataacgaattagagcccaccctaatgacttcattttaacttgattacctctgttaagaccctctctccaaatatggtcatattctaaattaataggagttaggatttcaatgtatgaattgggagggggcacaattcagcccataacaaaaagtataaggcatcattctttgcctatgctaaggaaagactttgtgggttagctgccaacaagtccccagccaaccagcacccagggaattcctaagcagttttgcatcttgttatgggtagcaataattaaatgacccaaagtggaggcagacagagtaggcaggtaaaacagacaggataatttcagattaaattatttcaagagtggcttgctattgggaaaagcacttggtgggccgcttgttttacgagtagagcgaaagttgaagtatgcattctctgggcccaggctctgggctcaggactaggacaagaaagaggactggtctcctcactgccccatgggctcctgttatgtgggggttgcaagagccaagctgatgatattacacctggtgttttgatggtgtggaggggacacatcagagaagggctcccaaaggaggtacatcttgcctatctgactgtaacttcatagctcattagccattctctgctacttggatttttctcctccttttttgtcatatcatactggaacatctctcaggcatatccttctcaggtatgtctctgggattggaccttcatggtaatagcagtgattgccaaatgggggactgaacacagatttgttattactcttgaatggtttgaacatggtgcactggattgtttcagctaaatggggcttgcattgctgcttgtgctgtagaaaaggcttatcacttctgaagttcgtcttcccaagggagtttcgttgtgcttttttatcattaaagagattatagtcgcagacctgtgccaaccagctgagtgaccttgagaagaccccttcttgctaggtctattttggcagagctgtaaactaggagaactgactggccttgactgctggaagctcctaggggaaggggaggactgtgcacgcttatcgaacactatgctttacctgtgccagctcactgagtcctcacaagagcccgatgcagcagggactgttttatcatcttcattttacaggcaaggaaactgaggtgcccagcagtgaagtgggtgggtggggggtttgaggcaggactgtcacccagatgatctgattttagcatgtgtgctctttgctgccccaccaccacacagcatggatgtcagagcaggttacagtgttcagagctcttcttcctaaataatttccaaatatgtgtgggtaaaacttttccatttcttggcttcatcctatacacgtatcatttcacttgctggagtatgtctaggtgcacttacgtgtgttcttgtgtctgtctgaaggtgcaagtctgggtgacacggcctaaagtggctgtgaatggtggggtagtagtcccctgtatacctccctgaggactgggagtcaagaggggtcagtgataagcagcaggatcgtgcagcatgaatggatttcagaaacttccgtggtgattgcttattgtattttactgtcaaagtagtcattccactcctacatatagacccaagaaaactgaaaacccggctgtacatgttcacagagcactacttataattatagcaaaaagtgaaagaaaaccccaaatgaccatcaactgatgaatggatgaacaaaatatagtctactcattcagtggacttttttcagccataagaaggaaggaaattcggatctatgctccaacatggatgaagcttgaagacatgctgagtgaaagaagccagtcatgaaagagcatgtactggatgattccattcatctgaggtgaccagagcaggcaaatctatagagacagaaaggagattagtggttgctgggggctgggggagggatgatgaggaggatggactgtttaatgagtccgggttttccctttggggtgatggaaatgtggaaaatgataggtgatggttacacaacattgtgaatatactagaaatcactgaatttcacactttcaacaaagctgttcaaaaaggagtctgaggtgcccaagcagaatttagtgaagggaagagatgggaggagtcttccgggcagagggacccctgagggccctgaggtgggatagagcctgctgaagtttagcaaccaagtgaagtccagaggtccagggtgtgatggggagctgtcatcctgtgctcagccattgtccttacaggtttggaaaacaaccacagctccccaactggcctcctacaaacaagtctccacacaacagagcgaacttctaaaaatgttgttttggccaaatgcacttctgcaactccagagttggccccttttagtgtaagttcaccaccctggcacaccttccttaactacccagcataaagtggattttcactctggagtaatgatgtggagaagagttctttcatccaagcagtagtgaacaatttaaatgcttgaaacagtaaaacagatgatggttattggctgttgtggtcagtagactaatgttccctccctgctcagaggtccacatcctaatctctgggacctgtgaatatgtgacgttacatggcaaacgggactttcaaatagggctaagttatggatcttaagatgggaaattgtcctggattatccaagtgggcccaatgtgatcaaagggggcctgatatgtcaaagagggaggtagatgtgattatagaagcagggtttggagtgatatactttgaaaatggagaaagagccatgagctaagtaaggaatgcaggtgacctccagaagctggcaaaggcaaggaaatggattggaagcttcagaaggaacacagcctgctggtgccccggttttaacccagggccacccattttagacttctgatctctggaactgcaaggtcataaaattgtcctgttttgagccactatgtgggaatttgttatagcaccaatagaaaatacagctgtctcatcatagcactttacttttagagcaccttaggggcaggcatgtgtgggggaatcagacctgtccagctgcatgaccccgtgctgctgcatctatctgagcctcagctcctcattggtgaaagaggctgctcatcggcaccatgccagctcacaaaccactgaagtgttgatgccatgtgtctgacatggcagctgctccttgctaggtcctcaataagtggatgttgtcctatattatctaatcccatcccttccttctacagaatgggaaaagggaggaagaagatgggagcaatttgcccaagttcgaaggcacagaatcaagtgaaggattcagatgtcttgacttggaggggagggctttcacatttggttagaaaatactcatggtaggctgggtgcggtggctcacacctataatcctagcactttgggaggccgaggcaggcagattacctgaggtcaggagttcaagactagcctggccaacatggtgaaaccctgtctctactaaaaatacaaaaaattagccgcgtgccgtggcacgtgcctgtaatcccagcttcttgggaggctgaggcaggagaatcacttgaacccgggaggcagaggttgcggtgagctgagatcgtgccactgcacttctgtctgggtgacagagcgagacttcatctcaaaaaacaaaaaaaaaagaaagaaaaaaaagtactcctggttagagagtttcttcagtcctggattggctgtgatacaagaaacacctcacttcttaggcagcatctgtacaatgttgttgcacctggggctcaacccatcagtggcctgtgcaagtagttgagttgcaactagcatattgaatgagataaaatggaataggaaatattagtccttcacacaaataagatcatcctttgttgcaacatttgtttctatggagtatcactttgttgtactgtgtttctatcactttgttgcaacatttatctctgtgagaatcactttgttgcaacatgggtagccctctggtgtaatatttgtttctatgtgcacgtccgctggtgcctacatgttctaggtagggatgggaaatttgggatccctgtcaggggcatgtgttctgtgaaactgggggataaacgtggtctactaagttgctgggctctgagtggtgagcatggccactgctgagctggccttaatggtgaggtgcctgctgccaagcctggcttggttcatgtcttaagggacacatgtgggctggaatgtggcttagaaagtaggcaagctagattccactttaggacatacaggagactttctttgggctcctcctgcttccctctccaacctgatcaggcatgttcaacaatctagacttgcaggatatttgtcatttctagttttttgttttgttttgttgttttaattggcttgttgtgtcctcagaacatctctattcttggcataccttccccactgggcttgtaaacaggcacaaatacagagtggaaaaggggaaaggtcagctgaatagctgtaattttattttgcgtagtattaaatgcttatttaatttatattatatagaactggcttagggatttagttggccagatcaagcagatgtgggcctagtaatgttccttgaagttgtcatacatcctatctcccattttctacagatgcaggaatcagtgggttcttactcacttggaagatttgtggtgtggaatgagccagactgattgcctgcttccatgacaagctggcttcagaaggttatggagcaggatgtactgatatacaagggctagctcattctgtgttttgttttgtatagtttcaatttgagacagagtctacctctgtctcccaggctggagcgcagtggtgcggtcatggctcactgcagcctcaacctcctgggctcaagcaatcctcccacctcagcctgctgagtagctgggactacaggtgtatgccaccacacttggctaattttaaaaaactttttgtagagatggagtctcaccctgtcaccctggctggctcaagtaatcctcctgcctcagcctcccaagtagctgggactacaggcatgtactaccatacccagctaatttttaattttttaaaaattttatagggacagggtctcactatgttgctcaggctggtctcaaactcctgggctcaagcaatcatcctgccttggcctcccaatgtgctgagattacagtcatgagccaccgtgcctggcctcattctgtttttgacgctgctcaccagattgcttagtcagtgtttacaaagcaccacagaagtgccaacggctgttggggcttcatcgcctaactgtgtacacaggtgttgaatttgagtgtgattgttgatagaggccacagtctgccattaggtatatttgggaagggaatttgagcaagctgtttcccggcagtatgacgcacatggacaagttcatggagaaaagttgcacaagtcaaagggaggaagtggttgaagtggaggttgtggtggggagacaggatctcctggtgcgggtagccagtgacccttagcacgggatccacatgtctaaaggagcatacgacagcaggggacaaacttattctttgtagtgccagggtaatctactggccagttttggggtcaacacaaaaaactttccaaaaacgtgactcttccaacgaatgaatgtacttccaaagcacatgcctgggtccccagcccagtgaattctgagggggaggaggtttctgaggttggtcagctcatcctccctggctgagaacctctattatacactggagattactttgctgcattttagggatggtcaattagatgatatttcagattctgtccaaagttaacatgccttgagataattggctttgtctttctgaattttgatttttaaaaagcatcacttgctgtttttttttttttttttaaattgtggaaaaagaacccacataatacttaccatcttagatgatttctaagtgtattgttagtggtgttaagggtgttcacattgttgtacaaccaatctccataacttttttatcttgcaaaactgaacctctaatcattaagcaatttcccatctcccactctccccagcccctggcagtcatcattctaccatctatctctgtgaatttgactactctagggacctcataaaatgggaatatagtatttgccttcttgtgattgacttattacacttagcataatgttttcaaggttcacccatattgttaaccacttgccgttattttatttcttcttttctgcattttctaagattttcacagtggacacacattatttgaaaacaaataatataatttatgtaatactgtgagaggtatagtacaagggggggggggcctgcaggccatagttaggcatatggagcttatattcagtgtagtgaggaggcctttgggagttttgagcagggaagtgatgtgccttgaagtttgtttaaaaaggaaaaaggaggactccctgcctgctgtgtggagaatggattggatggagcatagacctggaaggagcaggaggatggtgcttgtggctgtccaggggaaagatgatcgctgcctggcttggtagtggcagtggaaaagtggtgggctttgtgcatgtgctgggggtggaattgacagttcttggtgacagggtggctatggagaatgaaggagaagatgtcgggacagtgtacagctttctggcttggacaatgcagtgggtggctgtgccattcagtgaaacaaacagggaactcaggaaaagggtctaggttggagagccagggcttggcatttagttttgtggattctgagtgggagctggctgtgagatactgaggagtgatttgagagggagcaagcagatacagcaaggatagatagtcattttatgagtttggttatgaaggggtgggagagaaagcagtatcaagatggggatgtacagtcaaaagagggttttctagttaaaatgggagagatttgagcatgtttaaaaatagatggaatgatacttcccaaattgaactacagattcaacacaatccctatcagaatcccagctgtctttttgcagaaattgacaagctgatcctaaaattcatacagaaatccaagggacccaaaatagccaaacaagcttgaaaaacaggcacaaagttggtagactcacacttccccatttcaaaacttactacaacacaacagtagttaagactgggtattactagcacaaggatagctggaccaggattactagcacaagggaagacagagtccaattcaggacatgcttccttggaggtgctatggaaatctcccctgggtagcaggacctgcaggattggaattgaggacaaaggtctgggttggggatacagggtaggaggtgcctcgtgctcagcgcctttctccctctgcattggcctggccagatggcaaggctgaaaatcttgatgatttctgaggtcctgttccactctgcctggctctgatttggaaatgttcatacatgcaacaccaactagacatagattcttacctgacttaagaaagtacacaggatccattggtgtttatgctgccttcaggggaaggaaataccatgtgcatttgttattagtcaacagactgatttggggtggccttgtccaaatcacttacattcttgtgcctcagtttcccaaacttatgtcgtatcagtagaatctaaaggcttatcaagcactgggtgagtttagattagagtgtggcttttttctctcttcatccattaagcttttgaacattttaatgattctcttataagccatttactcatgcatatttattgaaggccttctacttactagtggattctacttaataccaaatttaataataatattagctaacatttgagggattcctatgtcacatattgtgctaaatgctttatatataatgattatttaatcctcacattaactcactgcagtagggtctcttgttatctccattttatagatgaggaaactgaggtatagcgctgttaagtcccttgcgcaaggtgtctctcctgctaagtggcagagctggtgtctgcatcctgcctgtttggctccaaagctggtcaccagtgccgatatcctcatgtgttgccctggaacagcctttgaccagagtttggaaaccttggccccaattgtgtgtgtgacaccagcagtgtcacctttgacaaacatgtagtatcttttatttttatttttaagttatttttattattttttcttttttgagatagagtctcgcactgtcgcctaggctggagtgcagtggcacaatcttggctcactgcaacctccgccttccgggttcaagcgattctcctgccttagcctcccaagtagctgggattacgggcatatgccaccatgcctggctcattttttgtatttttagtagagacggggtttcgccatgttgcccaggctggtctcgaactcctgagctcaggtaatctgcctgcctcagtctcccaaagtgctaggattacaggcgtgagccactgcgcccagctaacaaagcacttagtatcttgcactgcttcacagacactgtggccctgagagcaatgtgccacttgtcatagggttatcatgggaccctaagccttgtgacacatcatgacagcaccttatttgtctttgctagttttatttctatcatgccatccaccttataccatgggaggaggagtaatcaggtatgacactttcattttacacatggggaacaggtcactcctatgggatcaagtgattgctctaggacccccagtcagtgagtggcagtctgggacgagaccttgcatcttctggctttggggcagtttctatgtctgctacctaatgattaaccactgtggctcttgggctcccacccataaaaaggacatctgatctctgaggtcccagggcactcccccacagagtggaatgccagggacagtatatggagacacactaacaccatttttaaaaaactgaggcatcattcacaaaacataaaattcaccattttaaagcccacgactctgtgtttaatatactcattatgttgtgcaactatcaccactatctagttctagaaaacatttcacaacctgaaaaagaaaccccatgccctttagcctctagcagtcagtcttcattcccttcactccctagcccctggcacccactccatttttcttttgctaagtagttccctagctctcagctctgacttcttggaaaaggttatccttgcaggcatctgaggcacatttgggatttccttgtgaacaaccgttgtagacatttacgtttctgtgtgaaaaggaagattgaaattggcctttcaattacaaactcatcaacgaagtgacttatacaatttgttaaaaaagaaaaaaaatccttcccctgcatttaaattaagcaacctgctacatacggacgcttagatacttcccgggaataagtaaaagcactttaagacttttagacatggcgcttgcatctcagtgaccccttatttatcatgttttcctttccatagtgggtgactggaagagtcaccctgtcagtgaccgggtgccctgtcagtgaccgggtcagacctcttatggccactgcaggtggattggtggctgtggctgttgtggactgaaatgcttcatgtcattgttgtcctctctgggagtgatttaaatttattcatgaaattatttggagctcaggtggcaatagctaaatccatttagtaatcagaataagaggaaagccattttcatgttcacttgcaatgctgcagtgcttagcaagtccagaggatattaattactcagcatgctttgaggtgtgaaagcataaattcatcaagacaaatgtgttcaaatctagactgaggtaacaagagttaaaatggtgcaaacattcagggaaactggggactaacaactagcatttttggtttgcccccaccctctctagcacaaggtgggagagggatacctacttgtttgtgttaagggagagaagttgttttcaccaaagagacatttgtagaattggccatacataccagtgagtttgtcgcatagatttcccacaagcagtgtccaggaatgtttccatggtagacagggaggtgtgaagctgtttttctgacctgcaggctttcctttgattaatcacccccttgccagagggcaggggaaaggcaagtctttgcaagcagctgcatcaggtgaggtctttatcatatgatggtgaaacattcttattaaatggctcatttcaagttgaatcaagctatgctccccacccgtccattagcagactcaatctactgggactgatttgagtgttattccttgaacccaagtgatctagaggcttgtgccactgtcacatttgctgggtcacgattcaatccctcaggtccaactttgattctggtccatgttatagtgggccttgtttgcttttgttaatggtctcaccattgaccaagttggtttcctttttgataaatagctctattcccttgaatttgtggtgtaggtgcaggcagtaagcccagatgacaggcaggtgagtggcgtcctggctttcctggacaaacgtagggatagtgtgagtacttagcctccattaaggcagagaaatggaaaatcctgagatgatgcatctatgatttaccagactaagatgtccctggtatgctttcttattcatctacagaaaagggtcaggattttattatttattttattattattattattattttgagacagagtctcactgcattgcccaggctggagtgcagtggcatgatcttggctcactgcaacctctgcctcctgggttcaagcgattctcctgcctcagcctcccaagtagctgggactacaggcgcccgccaccatgcctagctaatttttttgtatttttagtagagacggggtttcactatgttggccaggctggtcttataactcctgacctcatgatctgcccgcctcggcctcccaaagtgctgggattacaggcgtgagccactgtgcccagcccagaaaagggtcaggattttaaaatttaaaaaccgatgcagtttaggtgagtattcactcacttaggatttatactggcccatcttccccccaaattgtaaactgcttacatgtacaaaggaagaaggtagaatagaaaccatccttagagagcaggggaaataaatgtaactggccacttgagaggtgccaatctccctgctagaatccctactttgcgtctgaaatctttggcagccaggggtcccagctgcctctgcagttattaatccagcagcaggcagcagacacgttcctctgcagagatgcttgctcttggcatgaaatccaaatggattttgtcacaaagtaatatcaggtactatctactggtgacagagttttggtaatcaaaatgaacacacctttaggaaatgctttcttgctgccaggtctgtgtgtggtgttggcatggagattaccaagcgccagtccctgcttaaggcagctcactgtctagagcagcactgtcctatggaactttctgtgatgatggaaatgttctctgtctgtgctgtcaaacacagtagttacctgctgcatgtggctatcaagcattgaaatatggttagtgcaataaagaagcagaatttaaaaaaattatcgaatgctaattttaatttaaacggccacatgtggctagtggctaccatgttaagtggggcgagtctagagagaggacacacaaaaacacttaactggaatggctgtactttcaggatgaactgagtggagtggatagcaacaacagaggagggaatgaataattaatgaaatccaaatgaaaggctacttaaggggcccatcaaatgatctctctcaaggatcagacgtttcaatcaggcattggcaggtgctggatcacagccagttcagggtggaattctctaacaagggcagctgtgccttgttttacagcctttattgaagtgcacccttagccttagctttagatgccagtcctgttgggtcaaattgcaacatgaggtcaagcttgtgttccttcccaaagggacaaaatctactccaggacagacactggctgttggagtgtctgtgggtggaaacagcacttttcttatgaaattaatcttctcaaggacatgcacaagtccatgggcaacattgccaaaggacattttcagagaagtattatcagctcattaggtgctttttacattaaaaggaattcttggtggccctctgcggtggaagtaattttctgctgaatacttgaatactggctgcccagatacagggactgcgggttgtgaattgagcctatggtgaatcagctgttttctaatgcgtgttggtgccagagggttagtctgtgtcactaacacagaggactgtggtctgcctgcatccaaaactgagtttagttaatagcttgcatagaaggggtatagaacatgaccctattttgcaccttttgaggtgcattgtatctcctgagaatatttcttctgaacttgattttagcaactgtgcttgcttgtgggctttgaagacatcttaatagctcaggatctagattgaaactgaatggttttatccacagatagtttgagtctgttgaatccaaggtcaacaagggatgggtacatagcacaacattgtgttatgttcctcttaacatatttacccgatgacatgtagcaggatatatgagcaagcagtagggggaatggctgaggctaaaaacgtcttattgtgtaagatgtcatttcagagaacctacttttgcaattcttgggtgaggaagcagagatagagatttgaaggaagacccattgagatggtaggcttatggctttggagggattgatgtagaacttttaggagaaatacacgtacatggattgaaaacaaaaaggcagaaaagagtttaaattaatgtaaaatgctccctctcccttcccctgaccgttactctcattccctaaacataactactgttaccagtttccctgtgtaaacttccagaagatgtttatggatatagatatggatacagacacgcaaatggaaaaatacttctctgcactttgctttatttattagtgtattgtggagatctcttgcatgccactattataggcttatcccattctttttaacagctacacaatcattaattgtatggaagagccatatttcatttcaccagtcatctttgctgaacacttggactgtttccatttctttttcctgttgtaagcatccttgtccatacttctttgggtacgtgtttctagtatttgtctgtaacaggtacctagaaattgaattgctgggttgaagtatttgcatattttaattttttaatgttgaaataattataaactttcagaaaattggcaagtacagtgcaaggaacttttttttcccccaccaagccacttgagagtaaattggttacctaatgccttatcacccccacccccaatatattagagtgcatttcctacaaataaggacatcttcttacatatctacaatgcaaccatcagaatcaggacactaacactgataccttattaccactaaatcctcagaccccatccaagttttaacaattgtcccaataatgtctattattaatacaaagagttcttgactgggtgcagtggctcatgcctgtaatcccagcactttgggaggctgaggcaggcagattgcttgagctcagaagtttgagaccagcttgggcaacatagtgagaccccatctctacaaaaaatacaaaaaagttaggcatggtggcatgtgcctgtgttcctagctacttgggaggctgaggtgggaagatcacttgaacccaggaggttgaggctgcaggagccatgattgcaccactgcaatccaacctgggtgacagagccagaccctgtctcaaaaaaaaaaaaaagtttatatatgttgttcacctaaattttccagatttatcacattttctgtatatgtatgtgttctccccaccccacgtgcatgtgtgtgtgtatgaatttcctgaaccatttcagaattagttgcaaacattagatccattacctttttttctttcttttttcttttttttctttctttttctttctttctttcttttttcttttttctttttgaggtagggtctccctctggcacccaggatggagtgcaatggcattgtcaaggctcagtgcagcctcaacctctcagactcaagtgatccccccagcctcagcctccagagtagctgggcgtacaagcatgtgcctccatgcccagctaattttttttttctttgagacggagtcttactctgttgcccaggcttgagtgcagtagtatgatcatagctcactgaagcttcaacctcctgggctcaagtgatcctcccaccttagcctcccaagtagctgggactacaggcatgcaccaccacacccagctagttttttttttattcttagtagagatgaggtctcactatgtggccttggctggtcttgaactcctgggctcaaggagtcctcccacctcagcctctcaaagtgctggggttataggcatgagataccatacctggtcccccaaccccaggctaatttttaaatttttgttgttgttgttgtggttgttgagatggagtctccctatgttacccaggctggtcttgaactcctgggctcaagcaattctcccgcttcagccttccaaagtgctgggattacaggcatgagctactgtaccaagcctatacctattacctcttgatacttcagtatgcagtttctaaaaacaaggatactctcttcctgactacagtatttccatcaagaccagaaattgacagtgatcagtattatcatctagctggtctacagacctaatttaactttgctgattgtcccagtaatggcctttataggttcaggatccaatcctagatcacctgttggatttagctgttacaatttccctaatctcaaggattgcaggctctcactactttcttgttcagtgctgattttgcctcatgggttttgttcattttatgatttacagtggaaaggcgggtctgatcccagttattctcatagcaagaagcaaaagtctaccttagaattttggaagctaggttattaagtgccataacttttatttactggtatattatatgctttatttccataaaatattgctcttttcctactttgagctttgggtcttgaattttatcttatattaatatcatatctgtttccttcctgttagtgtttgcctggtatatatttgttcattctctacatttttttgccattttgttttaaatgtacattttatcaatagcctatagttagatatcttttaatctcatttgtcttgtaatgggagatttagcctatttacacccccccccccatttttttttttttttttttactgatatgattatacgtattcctatgttaaagttcatgttttccgctgggcatggtggctcatgcctgtagtcccaacactttggaaggccaaggccggaggattgcttgagactaggagttggagaccagcctaggcaacatagtgagaccccatctctacaaaaaaacccaaaaagtttgttttctatttatcatagttctttttttttttttttttaacctctggtgacttttgttgggttgactgagttttggttgttgctattgtccttttattttttccccttaaatgggttttgaggttatatatcctggatctcttcatttagcagttgcccctaattggttttgctataagaaattgattttttaaaataagttttatttttgaacagttagatatacagaaaaattgcaaagctaggacagagttcccatatgcttcatatccagttttccctattaacattttatattagcatgatgcatttgtcacagttaatgaaccaatatagatatactattattaactaaagtctatactttattcagatttcctcagtttttatgtaaagccctcttctgttccagaatccaatccaggatccaatctaatccatgtgactgtcagtccttacgtcttcttaagcttctcaggctatgccggtttctcaaactctggttttaatgaccttggtgattttgaagattggtcagctattttgtacagcaccccccagtcaggagttatttgatgtttttgtcatgattagactggagttacggggttttgaaagaaagaccacagaggcaaagtgccatgcacatcacatcctgtcacattatatcaagggaacatactgtcaacaggactcatcattgtacatgttgaccttggtcacccggctcaggtagtgtttgtcaggtttctcctctgtaaagagtaaagtttttctatttcccctttatcatactgtaatcttgggaaggaagttactatgtgtggctaatacgtagggagtggtgaattgtgcttcacctccatgagagacagatagctacagaaatgaatttgaattattctgtatgagagatttgtctattctctctcttttgtttatttatgtaatcacttattcattcagcatggactcgtagatacttatgttatacttggggttataacccaatactactttattttgttcttcaaattgttccagctaatatccgtcctgaaaaaagtctttaaaaatttattccagccatagccactgggagctctttcagttggttcctgtgcccctttgacagataccaattgatgtgatttttaaaaatacttccaggccgggtgcagtggctcacgcctgtaatcccagcactttgggaggccaaggtgggcggcactagaggtcaggagttcgagaccagcctggccaacatagtgaaaccctgtctctactaaaaatacaaaaattagccaagtgtggtggcgggtgcctgtaatcccagctactcaggaggctgagacaggagaattgcttgaatctgggtggcggaggttgcagtgagccaagattgtgccattgcactctagcctggctgacaagaacaaagctccgtctcaaaaaaaaaaaaaataataatactttcttactttctggcacctcaagatgcttcaagattcaagctcatcttacatattttctgtcccagtcaaatcagccaaggacccctggttccctttttggagagtaggattagagacgaagacctgggtgctagatgtgctcattgctacggagtgttgttgcttccagccccgtccagttgacagagcaagggaatatatgtctttatactaacccatatatatactcatggctataaatatttctgtatatagctatctgtttatagtcacgtgccacatggtgatattttggttgacaggccacatatacaatgttgggctcataagattataatactttatttttactgtgccttttctgtgtttagatacacaaataccatggtgttatagttgcctacagtattcagtacagtcacatgctgtacaggtttgtaggctaggagaaataggctctaccatacagcctaggtgtgtagtaggctacaccatctagatttgtgtaaggacaccctatgatgtttgcataacaaaatggtaaaagtgtaacaaacacatctcagaacgtatccctgttgctaagcaacacatgactatgttaatattaagctaggccgggtgcagtggctcacacctgtaatcccagcacttcgggaggctgaggcgggcagatcacctgaggttgggagttcgagaccagcctgaccaacatggaaaaaccccatctctaccaaaaatacaaaattagctgggcgtggtggcagacgcctgtaatcccagctacttggggggctgaggcaggaaaatcgcttgaacctggtgagctgagattgcgctattgcactccagcctcggcaacaagagcgaaactccatctcggaaaaaaaaaattaagctaaatatgatttcatacttagcttaaagtctcctactctaatccatttttgtatgggtcattttagcctgcccctcttatctgtaacctctctctctgatagtgagaaacctggctcccaccatcccctatccatttacttaggtcaattccagtatgcatgcataatggtttgcttgagaactgataagctatacacccttatgacaaactacgtgcccatctagaggaaacagtagctatcaagttcagtaggacgctaggttgggcagatgggtccacttgtgaggacaaattctattgtgaaaaacttttccccagagctttttcagttatgtgtgattagccagagcctctagtctaggtggggtactggggatcggagagaaggtaccctggattgacaaagtatagagtagcctttgtgagacctggggtggggtggaagaacttggcccctcatcagtggagctgtgggctccaatgacccctcttacttctctatggagaaggttttctgtgagatagtacttcatgttcgaaacacctgagccttcaacattctagtggactgaagcttggggttttgttttgtttttattttttaatttttatttttggtggggatagataggttgtttgaggaaggctatcagctcagtatatctttgagtggctttgacagatttcccttttgtggagttacattcatgacactgtctaaagggccatgaccatttcaggagagaatttcagtattattttgtttcatacaaagacagttaaattttaaaatctttgttttgttatcgttgctttttacagacagggcctcactctgtcgcccatgctagagagcaatacacactcactgtaacctcaaactcctagcctccagcgatcctccttcctcagccttccaagtaattgggactacaggcgtgcaccaccatgccgggctaataaaaataatttttaacatttatttttaattgacaaataatctttgtatgtatttatagggtacaatgtgtgtagtaagattcattcaagctaattaacatatccattatctcacaaacttattttgttgtagtgagaattgtaaaagtctattagcaattttaaaatatacaatacattattattaattgtggtcaccatgcagtgcaataggttgctaaaacttaattcctcctgtctaactgaaactttgtgttctttaatcaacactttccctttccccatacttctccctcccctcagcctctggttagctacctttctactatttctgtcagatcaacttttttagattccacatctaagtgagatcatacaatatttgtatttctgtgcatggcttatttcacttagcataatgtccttcagttccatccacattgtcatgagtgacagaatttccttctttttaaaggatgtatagtactccatttatatatgtaccacattttctttatccattcatttgttaatggacacttaggttgcttccatacctttgatagtgtaagtaaaaccaaaatgaacatgggagtacagatatctctttaaaatcgtgatttcaattcctttggatattaatacacacacagaactgggactgatttctgaattatatgataatttcattttttgtttttttgaggaacctccataccattctccaaaatggctatactaatttacattcctaacaacttgtgcaagtgttcccttttctccatatcctcaccaacaaatatcatttgtcttcttcataatagccattctaacagatgtaagatgacatcacatttttgtttgtttttgtttttgttttgttttgtttggagatggtgtcttgctctatcaccaggctggagtgcagtggcgcgatctcagctcactgcaacctctgcatctctggttcgagagattctcctgcctcagcctcccgagtagctgggactacaggcacatgctaccgcgcccagctaatttttgtatttttagtagagacggggtttcaccatgttggccaggatggtctcaatctcttgacctcgtgaactgcctgccttggcctcccaaagtgctgggattacaagcatgagccactgtgcccagcccacattttggttttaatttgtgtttccctgatgattagagatattgagcattttttcatatacccgttgaccattcatatctcttcttttgagaagctcctttgcctttgcccatttttaactgggttatttgttttcttgctattgagttgagttccttatatattttggatattaaccccttttcagatgtatggtttgcaaatattttctcctaatccatgggttgtctttttactctgtttcctttgctgtgcagaaactttttagttttattcagtctcatttgtctactttcacttttgttgcctgtgcttttggagtcttatctaggaaatggttgcccagactaacgttgtgcaactttttccctgtgtttttttctagtagctttgcagtttcaggtcttgcatttaagtcttttattcattttgagttaatttttgtatatggtatgagataggggtccagtttcattcttccacatgtgcatatccagtttctctacatcatttactgaagagactgtccttgttggagatcaattaactgtaaatatttgagtttattttggtgctttctatcctgttccattagttcatgtgtctgtttttatgccagtaccatgctgttttgattacaatagctttataatatattttgaaatcaagaagtgtgatgcctccagctttgtgcattttgctcaagattgctttggctattgggggtcatttctggttccatacaaattttaggatttttttccatttctgtgaaaaatgacattggaattttgataaaaattacatcgtatctgtagatcactttggtcagtatagacattttaacaatattcttctaatacatgaacatgggatatattttcatttgtgtttttcatttttcatcattgttttatggttttcaaggtacaggttaggaggtacgggtcttttacctccttggttaagtttgctactcagtattttcttttttgatgttattataaatgggattgtttctttttttcagacagttcattgttcaaatatagaaatgctattgatttttgtatgttgattttgtaacctgctactttactaaatttgtttatcagttctcatagttttctggtggagtcttttttttttttttttgagacagagtctcgctctgtcgcccaggctggagtgcagtggcgcgatctcggcttactgcaagcactgcctcctgggttcatgccattctcctgccttagcctcctgagcagctggaactacaggcacccgccaccatgcccagctaattttttgtttttgtatttttagtagagacgggttttcaccgtgttagccaggatggtctcgatctcctgccctcgtgatctgcccgcctcggcctcccaaagtgctgggattacaggcgtgagccaccacgcccggccctggtggagtctttaggcttttctacacataagatcatgtcatttgcaaagagagacaatttaccttcttcctttcctacagagaggccttttatttcttgttcttgcctaactgctctggatataacttattctgttgaataggagtagtgagagtgggcattgttgtcttgttcctgatcttaaaggaaaagcttttaactcttcactattgaatgaatcaaatgattttttctgcatctattgagatgaatagctgggattacaggcatgcaccaccacacccagctaatttttgtagtttttgatagagacagagtttcaccatgttggccaggctggtaccaaactcctgacctcaagtgatctacccaccttggcctggcctcccacagtgctaggataacaggcgtgagccactgcacctggccgtctcaagatatttttaaattttccttttaatttcttctttgacctgttgattgtttaatttccacatatttgtgagtgttccaagatttcttctgttgtttatttctagtttctggctattttggtcagaaaagatacttgatatgatttcagtcttcttaaatttgtaaagacttgttttgtggcctaacatatgatctatcctggagaatgtttcgtgtgcacttgagaagagtgtgtattttgttgctgttggttggaatgttctgtaaatatctgttaggttcatttggtctaaagtgtagttcaagtccaatatttccttattgattttctgtctagatgatctgttcaatgttgaaagtaaggtattgaagtgttctactattattgcattgcagtctctctctctctttagatttattaatatttgctctatatatttaggtgcttcaatgttgggtgtgcatatatttacaattgttatactttcttaatgaattgacccctttagcatataatgaccttctttgtctctttttacagtttttgactttaaaagtctatttttcttttttttacttttatgttcagttcagggatacatgtgcaggtttgttataaaggtaaacttgtatcatgggggtttgttgtacagattacttcctcacctaggtaataagcctagcacccattggttatttttcctgaccctctccctcctcccaccctccactctccaataggccccagtgtgtgttgttcccctctatgtgttcatgtgttctcatcatttagtcccacttataagtgagaatatgtggtacttgattttctgttcctatagtagtttgctaacaatactggcctctattttgtctgatgtaagtatagctaccaccactcactttgggtttctatttgcatggaataccttttgttattccttcactttctaaagggaaatgaccatttctagaggatatttcattattactttgttttatgcaaagatagtttaatttttttttttaatttttaggatctggggactttgatgattttaacctggaggatgcagtgaaagaaacttcctcagtaaagcgtgagtagtaaatcaaataaactattaaaaacaaacagtagtgattaatgtgtatcatccactcagaatatatgcgcaagaaaaatgatatattttacttgatcagatgaaatatggatagtgcccggacacggtagctcacgcctgtaatcccagcaatttgggaggccaaggtgggaggatcacttgaggtcagaagttcgagaccagcctggccaacatggtgaaaccctgtctctactaaaaatacaaaaattagccgggtgtggtattgcatgcctataataccagctactcgggaggctgaggcaggagaattgcttgaacccggggggtggaggttgcagtgagccaagatcacaccattgcactccagcctgggtgatgaagcaagatctccgtctcaaaaaagaaaagaaaagaaaagaaaagaaatggttgtattatttaaaataaaatttgaatatttaaatcctttgttaagaatacctaacaatgtgtgataactgatatatcagtttctgtagctcaagtcatagcccctactggtgtgacatatcagcagtggcctccaagggctgtcttccttaactcagaaaaaaaggcactttgaagtgaataaaagatttgtttctccttttagattgattttataatggctttttttttttcttgacacaggatcttactctattgcccaagctggagtacagtggcacgcaccatcttagctttactgtagccataaactcctaggctcaagtgatccttccatcccagccttccaagtagctggaactataggtgtgtgctaccacacctggctaatttttaaatttttttgtggagacagaatctcactgttttgtccaagctggtcttgaactcgtggccttaagtgattctcccattttgccctcccaaaatactgagattatgagcattagccaccacacctagtcatggcttttcttaaaatggagtctgtgtagtttctcaaatgctaagctttgttatcaattttccttttttttttcattttttaactttatttatttgtttatttatttattttggagacagagtctcgctctgtcacccaggctggagtgtagtggcgcaatctcagctcactgcaacctccccctcctaggttcaagcaattctcctgcctcagcctcccaagtagctgggactacaggtgcgtaccgccacgcccagctagttttttgtatgttagtagaggggatttcaccgtgttgcccaggctggtctcaaactcctgagctcaggcaatccgcccgcctcagcctcccaaagtgctgggattacaggtgtgagccaccacgcctggcctccttaaaccattcttttaaaaaatgataactacttataaagtaaagccaaggtttcccttgacccttctcccttctaactgacatgagaactactgtagtcagtttggggcatgttgatcccaattagttttcaatgctgttaggtgcatctacagatagaaattgtttggtctttttttttgtttttttaatgttaacaggtgtgaggctctttcatttaatgtgtattgaaatccttagagaacatgtctatgttggttttttccagctgccttaggaatgtaccacaaactagatggcttaaaacaacagaactttattctgtcactgttctggatgctagaagttctatatcaaggtgttggttgggccacattctctctgaaggctctagggaagaatctttccttgactttccccacttctggtggctctaggtgttccttggtttgtggttgcatcactccaatctctgcctctgttgtcacgtggtgttcccctttctgtgtctctctcctttctcttacaaagatgcttgttagtgggtttaaggcccacctggataatccaggatgatctcatcttgagatctttcacttaattacatctgcagagatcctttttccaaataaggaaatatatatttatagatatataatatatatacacatacatatatgtgcgcatatatatatacacacatcccttattcgttttaagcactgcacggtatgccatagtatgcattcagtaaatgtctgagtgccagctgtgtatcagttactgttttaggctttggggctacagccatggacaaatcacacataaacctgtgccttgtggagccagcgttccagtagtgtggatttggccatgacctgtattgccatttccttactggcagacacgtggtttatttcctttttatgcaattacaaatagggctacagtggacattcttgtccatgtcctttgtgcctaagtgcattgtgactgctaggaccaaagatatgtgttttttatattataaaaaacgctgccaaattgttttccaaagtggatttgccattatgcactgtcactgatgttgttataatagtacctgttttcccagacccacgccaacactgaattttatcaataaaaatattttaccaatatgatggacaaaataatatctcattgcttattatgcattcccctgattgtagtcaaatggagcatcatatatttactggccatttgcatttgcctctttggtaaattgttcacattcttcccccatttttctgccagattgcttgccttttaaaaatgggtttattaagatctctttgtattatatattgagttgagaaagtcaagggctttggagtcagacttcttgggtctaaactctacctctgccacttctgaactgtcaccttgggtaagtcacctgacttgtctgcacctcagtttccttatctcttacatgaagataataagaagccctacctcctaggatcactgtaaggatgacatgggaggagccatgtgaagcactcagcacagtccttggaacaaggtgagtgctcagtaagcattagccttactgttgttctttgactgacttgattggaaggactgactgtggctgggcctgtggtgtaagagtcaagcagacctaaatcgggtgacaaactcaacacaattcctgacaaaatcccagatggattttttgcagaagtggataagctgaccttaaaattcatatggaaattcaaaggactcagaatagccaaacaatcttgaaaaacaagaaaatgatggagaacttatcaattgtagcactgactatagacctacaataatcaagatagtgggctactggctagagatcaatggaatagaactgagagtctagaaataaacccttagatctatggtcagttgatttttgacaaagacgccaagacctattcaaagtgaaaagaacagtcaatcttcaacaaacagtgcttaggaccataggatatctacatgcaaaagaatgaagttggaccgttacctcacaccatacacaaaaattaactccaaattgatcataaacctggaagtataagtctcttagaagttaatttttgtgtacagtgtgaggtgagcggtttgggcattctcaggtctttcctggatattcatgctgtcctctgcatgcaggtgtcctcttagatccccaggaaaataaatacacttaatttattagcaatgatggttttaatgaaatcatttaacatctccaaaacaaacaggaccaaaacaaacttgataaatataaatagactttcaataaatttgtcaacttcttgatgggaacttttaaaatctcagcatatcatacctccaatcgacagggactttttaatatataaaatccctttttgagtcttgtgctgacccatctgatcttcctcatcagcacccatcagccagtgtctctgggaacccctagaaccacctgtatgtgatgtatgtgtttgaatgacagcccacaagaccacatcatgctgccacccttttttctatcttagcttatgtttctcgtaactgaggtttcaaagagataggcctctccacctcaccttggtccagatacttatcttgcagagaatgttcttctctgcacgttgtgcattcctctgcttgttttaaaaacccctgaaccacctaggccagagattgtatcgtaaatgacctttatttatttattcaccaatgttttttgagtgccggcttgctgctaggtgctaggcctaacaatgtggaagaggtcactgcccttatgaattgttttctctggaaggagacatacagtacctaaaatattttcagatattgctgagtactctcaaccaaattcaagggggtgatgggatagcaagcgcccaagattaggggcagctactttaaaattaagtggtgaaggcatctctgaggagaggtaatgtgcaaggaagtgaggaaggagacttcgaggccaagagatcagctgtaagagttctgaggcagagaagagccaggcttactctgtggcccggaaggcagcctgtgtggctggagtttggagaatgttggagaaaagacagagaagttgtcaggggacagatcacacaggatcttactagtatattcacaaggttgcacaaccatcactacagtctgttttagaacacttttattacttcaaaaagaaacattgtatcctttacctatcacttcccaatcccccaattcttcttgtttccacccctcacccccaagcaaccactaatctctttctgtctccatggacttccctattctgaatatttcatatcaatggaatcattcaatatgtggactttatgtttggctgctttcacttagtgtaatgttttcaaggctcatccatgttgctttcagagtcctccaccactctcaccatctcttcctttctctctgtgtgtgtaatcatctcatgggggaacacacttctgattctgccaaataaagcttcttatgaatgtccccattccctgggaataccatgggccctgtattagtccatttgtgctgccataacaaaatgcctttgactagatactttataaataacagaaatatattgctcacagctctggaggctgggaagtccaagatcaaggtgctggcatattcagtgtctggtgagggctgctctgtgcttcataaatggtgccttctagctgtgttctcacatggcagaaggggcaaaagggctgcctcaagcctcttttatcagggcactaatcccatttgtgagaacggtgccctttgtgacctaatcacctccccaaagtcctcacctttgaataccatcagtatgggggttaagtttcaacatgaatttggggctgggtgcgggggacatatacattcagaccaagcagttaccattattaagccacacctgggggaacccaccctgtttttactgtttcggtacagcacgatattacagagaatcactcctggtcagagtgccatattgctggaagcatttgctgagcagctaagaattttttctgagtttgtcattttgagaaaggcttcacagaaatgggtctctttattttaggagctaagtgttttgatgaagttgacctactattcttagtccttgataagtagactcttctcatctcaattacgaataagaaatcccatttaaagacttacaacacaaaaatctgtagttaatagtttctaaaaatgtgcataaattgaagctcttgttctacatcaatacaagcttgggctctgacacaacaactgattccacatgcatgtagggactgctgtctcttgaatggcacctgcagatcttcagagaaacgagacgtttccagaactggaattgcagggcagaactgcacaagtaatcaagactgtgtggaactatgtggtaccgtaattaagactgtgtggtactggcatcgcataggtcaatggaatagaattgagagtctgaaaataaacctttatatttatggtcagttaattttctttaagacagataaacaaatacttttacacaagagttgtttgagtcatgcaaattttaagctaatatttacataagtggcaattgcttttctggaacttgctcaaataatggtttcagtaatttctcttttttacctatctatatcataatataattatacataaacaaactcatttagacaagttatactcttgcattttactggtacaaagtcaaatggaaattagagacaaaattatctctaaactgatgatgagatagattaaatatatacatagatacgcatgcataatgactacaggttatcacatgtggttctcttaccataaatatccattcactggggtgtgtggtcttcacagtgaggtatgagttagggtacccaaaatcttcctaaggagtagtgtgcaaacattatcattttaagggaaagacttcccatattctcaacttccaaatacagtttttactaaaacagctaactgcaacaacccccttgctatggtttggaagtttttcccctccaaaattcatgttgaaatttaattcccaatgtggcagtattgacaggcaaggtttcttcttcttcttcttcttcttcctcttcctcttcctcttcctcttcttcttcttcctcttcctcttcttcttcttcttcttcttcttctcctccttcttctcctccttcttctccttcttcttctcctccttcttcttctcctccttctcctcctcctcctcctccttctttcttcttcttccttcttccttctttcttcttctttcttcttccttccttcttcttcttctttcttcttcttctttcttctttcttcttcttctttcttctttcttcttcttctttcttctttcttcttcttctcttttcttcttcttttcttcttctttcttcttcttcttcttctttcttcttcttcttcttcttccttcttccttcttccttctttcttcttcttcttctcctcctcctcctcctcctcctcttcttcttcttcttcctttctcctcctcctcctcctccttccttcttcctcctcctcctccttcttctttcttcttcttcctcttcctcctcctcttcctcctcctcttcttcttcctcctcctccttctcctcctcctcctcctcctcctccttccttcttctcctcctcctcctcctccttccttcttccttcttccttcttccttcttctttcttcttcttcctcttcctcctcctcttcctcctcctcttcttcttcctcctcctcctcctcctcttcctcttcctcctcctcctcttcttcttcttcttcttttttttctacaaatgagacagggtctcgctatgttgcctaggctagacttgaactcctaggctcaagtggtcctcccacctcagcctcctgagtaagaggtgattgggtcatgagggttctgccctcatgaatgaattaacccattcatggattaataggtgaatggattagtaggttatcatgggagtgggactagtggctttataagaagggaaagagagacctgagctagcaaccagccccacttggcatttgatgtcctgtgccaccttgaggctctgcagagagtccccacctgcaagaaggccctcactcacaaaatgcagcacctcaaccttggacttctcatcctctatgactgtaagaaataaattcctcttttttataaattacccagtttcagctgggcgtggtggctcacacctgtaattccagcacttggggagggtgaggcaggtggatcacttggggtcaggagtttgagaccagcctggccaacatggtgaaaccccgtctctactaaaaatacaaaaattagctgggcgtggtggcacatgtctgtaatcccagctacttgggaggctgaggcaggagaatcacttgaacctgggagacagaggttgcagtgagccaagattgcaccactgcactccagcctgagcgacagagtgagattccgcctcaacaataaataaatacataactaaataaataaccaaccaaccaacccagtttcaggtattctgttataagcagcagaaaaaagactaagacattgtgttagtccattctcatgctgctaataaagacatacctgaaactgggtaatttataaaggagagagttaattgactcatagttcagcatggctgtggaggcctcaggaaacttacaatcatggtcgaaggagaagcaaacatgtccttcatatggaagcagcaagaagaagtgcagagtgaagggggagaaaagctccttataaaaccatccaatcttgtgagaactcactatcacaagaacagcatgagggtaacctcccccatgattcaattacctcccactgggtccctcccatgacacgtggggattatgagaactacaattcaagatgagatttgggagagaacacagccaaaccatatcagacatccttctttaaaaaaataatttattgaggtaaaatcatacaatgtaaaattaaccattttatttttaaaatttattgtgtatatttgaggtatataacatgatattatgagacacatatacaacttggtaaatagttactctagtgaagcaagttaatatatccatcatttcacataattacccattttttttgttggacaagaagagcaatatttcatttagcaaaaattccgaatacagtacaatgttattagctatagtcctcatgttttacattagatcactagacttgttcatcttacatatctgctactttgtatcttttacccttcatttaaaagtgagcaattaagtggcattttaggatattcttaatgttgtacaaccacctcctttatccagttccaaaacatttccatcacttcacagcaaaaatcccttacctatcaagcagtttctctctattcttttatcctcccaaccccaaataaccaccaacctactttctgtatctgtgaatttatcctggatattttatataaatggaactggacagcatgtagccttttgtgcctggcttcttttgtgtagcataatgttttggaggcacttccatgttgtagcatgtataagtacttcattcctttttatggctaagtaatactccattgtgtagacataccacaattttgtttatccactcatcagttgatggacatttggttgtttccacctcttagcttatgaataatgttactatgaacatgctatatacacgtacttatttgaatacctgttttaaattcttttcgatatatacctaggagtagaatttctggttactatggtcattctgtttaactttttgaggaattgccaaattgttttccacagtggctgaagcattttacattcccatcagtaatgtatgagggttccaatttatctgcatccttgccaacttgtttatttattttttttaaatgaaagccatcctagtgtctgtgaggtgggacctcactgtggttttcatttgcgtttccctaaagactaatgactaatgatctctttatacatttatcatatgtatgatttgcaaattttctcctattttgtagattgtcttttcactttcttgataatgtccttagatgcacaaaaattttaaattttgattaatgtgtaatttatgtgttttttcttttgttgcccatgctttgcatgtcattgctaagtatccattgccaaatcaaaggtcatgaggatttacccatatgttttcttctaagagtggttttagttcatatatttagatgtttggtccatttgagttaatttttgtatatggtgagaagtagtggtccagttttgttaacatatggttatccagctgtctgagcaccatttgttgagaagactgtcctttctccattgaatggtgttggcatcctgttgaaaatcaattgaccataaatatgaaggtttacttctagactctcaatcctataacattgatctatatgtgtattcttaagctagttccacactattttggttactgtagctttgtagtaagttttgaaattgagaggtgtgactgctattttgctctttttttaaagatcgatttggctatttagggtcccatgcaattccatgtggatattaggattagcttgtccatttctgcacaaaaggcagttggtattttgatggggattgcacaggatctgcagattaatttgggaaatattgccattttaacagtattgagtcttgtaatctatggacgtaggatttcattccattaatttaggtctttaattttttaacagtgtgttgtaacttttagtgtacatgtctttatacttccttggttaaatttatttctaacagttttattctttttattgctattataaatgaaattattttcttcttttgctccttgtattgatcattgctagtgtatagaaatacagctgattttcatgttgatcttatatcttgcaactttgctgaactcattagttttaatagttttttttattgatgtggattctttagggttttctatatataaaatcatagcatctgtgaatagagatagttgaacttcttcctttctaatctcaaagagtttctttctttttcttgactaattgctctagttagaacttccattacaatgttgaataagagtggtaagagtggacatccttgtcttgttgctgattctaggaaaaaagcttttagtctttcacctgtaagtatgctgtcaattgcagatttttcacagatgccctttatcaggttgaggaaattctcttttatttctaggaagttaacagatgaggccaaaataaaccatctaaatgcttttaaaaatccaatagagtaagcctaattatcattaaaaagcacatagagagtagactctgatgaagtaagcagaacaaaatgggaaattctcttctattcctaattcattgagtgtttttatcatgaaatggtggttgactttcgttaaatgccttttctgcatctatggaggtaatcttttttttttttttctccttccattctattaatatgggatagtacattgattgattttactgtgttgaactactcttacattcctgagataaacccctcttggtcatggtcagtcctaatatggtgctggatttggtttgctagtattttattgaggatttttgcctctacattcataagaggatttttgcccctatattcataactgtattctgtagtttttatgtgtatttgtctgacttcggtattaacatactactggcctgatagaatgagttaggaagtgttctcttctcttggtttgtttgtttatttacttatttgaagagtttgagattaattggtgttggttcttttttaaatgtttggtagaattcagcaattaagacttctggttccagaattttatttgtgggaagtttttggttactgactcaatctcttgctataagtctagtcagattttctatttcttctcaagtcagtttaggtagttgtgttttaataggaagttatctgtttcatctaggttattgaatttatttggattataattgttcaagatattcctttataattttttatttctctaaggttggtagtaatgtcctctcattcctgaaattagcgatttgggtcttctctctctttatcttggtaagtcttctacagtttatcaattttgttgatcttaagagatctttcctcttttgttctttatttttctcttctctctttcattttatttccgctataatctttggtgttttcttcctctgcctgctttaggtttagtttgctcttctttttctagttactctttaaaattgttatgtaggttttattttataataatgaacttaactctgcaatccagctagacatggaagggaataaggaaaatatggaacccaaagagcttcagtgagtgcacaaagattataggatattgagagcaaatggaattgaggggtgctctcttgagctacagaggaaatagtctggtggttaagataaaacaggtcaaatttattagagttgtccatatttggcaatggtgatcttcttgctggtcttgccattcctggacccaaagtgctccatggcttctgtggcattcatggcctctttgaccttgccaaagaccacatacctgccattcaaccactcagtcttggcagtggagatgaaaaactgggaaccatttgtattcggtctaccatttgctgtgggcaagatgccaggacttgtatgcttcaggttgaagttctcatcatcaagtttctcctggtagttagatttgccaccattactattatggcatgtgaagtccccaccctagcacataaaccctggaataattctaggaaagtaagaacccttataaccaaatcctttctctccagtgctcagagcataaaagtttcctgctgtctttggaacttgtctgcaaacagtttgaaggagacctggcccaaggactcaccttagacagcgacggtgtcaaagaacacagtggactggaccggggttgacgatggcagtgtctgcaaagccttctttttctagtttattaaagtgaaagtttaggttatcgatttgagatctttctctttttttaatgtaggcatttacagctataaatttccctctaagcactgctttcagtgtaacacataagttttggtatgttgtgttttcattttcattgatctcaaagtatttcataatttcccttgtggttttttttgacctattggttgtttaggagtgtgctctttaattccgtataattgtgaattttccaaatacccttctgaaactgatctctactttcattctgttgtgctgaagaacataatttgtttgtgctgaagagcataatttgtatggcttcagtctttttaagtttattgagatttattttgtaacctacatatggtctaccttgaagaatgtttcacatgcacttgagtagaatgtgtattttgctattgggtggtatgttctataggtgtctgttaggtctagttggtttataaagttgttcaagtcatatatatatatatatatatatctgcctacttgtttcttctgtgattgaaaagaagatattgaaatttccaactatttttgttaaatcatctgttctcttcaattttgcaattttttgcttcatgtattttggggctgtgttgttaggtgcatatatatttaaaattattatgtcttcctcttggattgatcctttcatcattataaataattataaattgtcactctttgactccattaacaatttttgttataatgtaaatcttatctgatattagtatagctgctccagctctcttatggttgttgtttgcatagtatatcttcttccattcttttactttcaacttatgttttttagagatggggtcttgctttgttgcccaggctggagtgcagtggctattcacaggcatgatcatagtgcattatagcctcaaacttatgggcttaagcaattctcctccctgatattcccaagtagctaggactacaggcacatgacactacacctgacctcaacttatttctatttttgctgtttgttttctgaatagtcaataattattgggtactcgctgtattcaaagctaaacctgtttcacctttgcctttcccattccttaaatctttttctctgatattttcaatagtgagaatatgtgcaacatagtcttgatgtttatgaaaagaaactattggaaaaacttcatgcacattgtataattcttgtgaaagttatctacaatttttaaggaatgtggttgagctcaaaagacctaatatttccagtagtaaccacacttatttttttttatttgctaattgttatttgcttttgaggatcttaatatgttaactttatgtggataattttttttaaatcgtcaattagctcattgtctttattaaattacttatataatacaacttaagggacccagaagtgtgctgcaagcctcttggggtcaccacttttatttttatttatttatttatttatttatttatttttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgaggatgatggtttccaatttcatccatgtccctacagaggacatgaactcacccttttctatggctgtatagtattccatggtgtatatgtgccacattttcttattccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaagggttgaactagtttacagtcccaccaatggtgtaaaagtgttctacacttatataaaatattgtgtgcatgtcttgtaaccactttcagtttatgaaatactcccatattccactaggaatgtaacctcagtctatccctgagcaggattatctatgtttaaagtgccaggttgatagttgtggaaccaaggcttggagccctcaaggatcatgctcaggctgtggaactccctggaccacgtgccatctccagcagatctgggtgcaagcccaggttcactaatcaccaggtcacatgtgagaccatgtccacctcaccaccctcagcctccaaagaaaagtgagcagaactcttctcatttaaacctatatcattttgtcatccttttcagtgtgattctctggagctcctagctagaggggcctcaaggaccaagacaaggatattctactcacaatgtgacttccccaagtcataaagtagctgctgtgttttgttactaaacgtgctccccttgctgtcctccctctcccttttagagccatgggaccacaccaccaccaccacaaccaataggccaggaaccaccagagctccggcaaaacctccaggtaatgtggctgccttaaggagggcagtgaggaagggccctctggagttccctctggggtagcatgcaagtgaactacctacagttttaagccccatgtgtgcagaaacaatcaaggcatccatgtgaacactgagtttaactttataatagagtgcatacctggctgatcactatgccttctgtgtgttttatgaaaagtcctgcctgggaaaatttcaagaggaaaatgcatttggacttcttcccctttttagccgtttcattttctaaaatcagggaaaatgtaattgtttaggttttatgaagccgatcaagcattttctttaggcagatggaacattttggaatggcatttattttacagtgtcatctttcagtaaaggattttgggacttggttcttcttaacaactctttcctgttgtcacttgaccctttcttcagatgggccactttacgatttagacatcttcactgatgtaaagaaaaatgtgacggtgtggctgggatcccagtcattgctcccatccagcaacttgttaccagtagtcgggggcatgataatacgttctgtgcggtagagagctacctttcttccgaagagacactgatgatgcaagaaagtcactgctgctttatgatttgccctcatttcttcacatttccacattcaaaggggtgcttcatgaccacatgacctctcccttttggttgtcctctttatggactctgtgtacctggttttgaattttgggttaatacctacagtcagtgagtatactgttaaaatggtccgactgctagcctaagcagaaaatacctaggaatataaattaattgaaaaactggtggtatactgcaaagtcagaaagtagtaactttttctatcctgcagatattttcattatcaatgtctgtacacagaattggattccaatataagtctctttgtcttaacccattgttggtattgatcagttgaacccatgggcattttgcttattttggaatcttatacccagttgttaatcagttggctgtttcctttatgttttggggcccactgaaggtagtggattggacttggctgatgctttggatgatcaagatgatggccgcaggaaaccgggtataggaggaagaggtaagtctttgctggttgaaactactacaggattctgtctcattaattacaacatcaacatcccacagagccagagtcagtctgggcttggcagaggtggaggcacttcaagccactggagaaccctgtaacagtagttctcaaaccttttttgtctcaggactccccaaatcattgagatctcaagagatttttgtttatgtgggtcacgtttaccaatgctcatcatcttagaatttaaaactgaaagactttattaatctaaaatgaacaacactaaacccatacatttaacataaataacatttttatgagaaataactatgcttggtaagacaaaaacttatattgaggagagcggcacgctgttacatttttgcagatttctctcatgtctggctggatggaagcagctggcttctcacaggcactttattccatcgtgagatgttgttttggttgaagtatatgaaggaaatctggcctcacacccataggcagtggggaaagggaggaatattttcacagacttttcagatccttgtggataatcttctcggataggacaccaaaacttggccccaacaaaagcggttgtttcttacaggttaagcgtagtgtggagtgtgaaactctgtcagtgaactttgcacacttggttccgtgggactgtcttgtcctttcaatggatcttttacccattcatggttttgtaacattgcatgttggtcatttggaaaatattagtgccttgaggtttttcgagcttccaagtaatgccatgtgtcattgtgtaaaactgaaagtcatatttgttcatatcatcacccatctcatttgaaaaaaatatgcattggggaaactgttaaactcacagtggtagaaaaagatgtttttgaagttctaacttttccttgaaatcttatcattggcaacaaataccatgagtgggtttctttaaattgacaggctcattcattttcaagaaaacatctaacagatattaaagttggcaaaaccatagttggttttaaaaaatctttaaatattgattaattactcttcaattcactttttcaaggaaaaaatcttctttgagaggaatggctcatactgctcagaatggaaataatcacataaagcagtttttttatgtcaacttttgtatttccatgtgccacataaatgcttgaaatgtacttcctgttttgttagaaaatattaaaaggtcgtgctctcatacaattaaaacatttttaacttcctcatgttagttttccagtgctgctgaacatgctatcataaacttagtagcttaaaaccatgttcacttattttctaggtttccctgcgctgctgaagttcagccatttaagtgtcaaaacttttttgacaaaatgacccttgattctcaactttctgtttacctactttttaaaatttaaactttcatttttagataatcatagattcgtgtgtagttgtaagaaataatagagaaggaccccttgtacccttcacccagtttcccctaatagcaacatcttgaaaattgtactctactatcatagccatatattgacatagatataatctatgcatttattcaaatttcctagttttgtttacactcacatgtgtgtgtgtcttctctgcaattttatcacgtgtgtaggtttgtgtatctatcatcacagtcagatacaaacagttccgtcaccataagtatcccatgattacattttataaccacacccaccttcctacagttctatttccccttccccatccctttcctaacccctggcaaccactgatctgttttccatttgtaaaatgttgtcatttcatggcattcagttttggggggaggcaaaaaaaaaagttgtatttcaaaaatgttatgtaaatgtaattataaagtagataaccctttggaattggcctttttcatgtataattcagttggcatccattcatattgttgggtgtattaattgctcattcattcttattgccaaggagtattccatgggatggatgtaccacagtttgtttacttgatgtattgaccccagtttttggctattatgaacaaggctgctgtaaactgtcatgtatagtatttttgtgtgaacataaatttttctttctttatgaataaatgcccaagagtgcagtgactggatcacatggtagttacatgtttagttttgtaagaaatgatcagttttccatgaagactgtaatattttgcaatccctaattcattgtgtcagtgccattttctctgtatcttcaccagtatttggtgctatcactatttccattttagccattttataagtgtgtggtaatatcttattgtggtttagtttgcatttctctggctaatgatattgaacaccttttcatgtatttgtttgccatctgtatatccttttcagtggaatgtctgttcatgtttttggtccattttctaattagattttttgtttttcttactattgagtttgagagttccttaaatattgtagacatttgtccttagtcagatatatggtttgcaaatattttcttccattctgtagcttgtctttttatcctcttaacagagtcctttgcagaagttttagattttgatgatgttcagtttgtcaatttttccttttattgatcatacttttttttgtgtgtgtccaagacagggtctcactctgttgcccaggctgcagtgcagtggcatgatcgtggttcactgcagccttgacctcccgggctcaagtgatcctcccacctcagcttcccaagtagctgggactatagttgcacaccaccacacttggctaatttttgtattttttgcagagatagggtctcactatgttgcctaggctggtcttgaactctgggctcaagccatctacccaccttagcctcccaaagtgctaggattacaggcatgagccactgcacttggcctggatcatgcttttgatgccaagtctaagaactctttgcctatacctaggttttatagattttctcctatgttttttttcctgaaacttcgcttgcttgcctgtgaatgtctaattgttctaggaccatttgttaaaaagactatctgcccgttgaattgtttttgagccttaaaaaaatcatttggaatataactgtttttgttgcacttggtatccttatattttgttgaggatttttgcatctatattactaacagaaataggtttgtagtttttcttgtgatgtctttgtctggttttcatatcagtgcactactgatttcattggattatttaggtagtgttgtctcctcttattttctggaagagttactgaagaattgctgttaattatttaaatattttatagaatttatcagtgaaggcatttgactctgggcttttcttttggggaagttttttgtattattaattctatctattataggtctattcagattttctatttcctttttaaaattttattttatttttgatgctctacaccttcagagaatcttctctaataacaaactacagaaatgatccctgaaagtagagtcttaagtctcttttattgcagtcatcttcgtgggcgtgaagttgtgtcttattgtcttattgtggttttgatgtgcatttccctaatgctaatgaaatcaaatatcttttcatgtgctttattgaatattgtttatgttttttggagaaatgtctattcaaatcctttgtccattttaaattgggttattgtgtttttattggtgagtttcatttttatttttattttgtttaatttaatagagacagggtctcaccatgttgcctaggctggtatccaactcctgcgctcaggtgatcctcctgcctcagcctcccaaagtgctgggattacaggcatgagccaccacgcctggccagattttctatttcttcttgagtcagcttcaatagtttgtatctttctaggagtttgtccatttcatctaggctgcccaatttattggcatacttttgtcaatgatattcccttaaaatcctttttatttctattaagtcattagtgatatcctctctttcatttctcatttcagtaatgagtcttctctccttttctttgtcagtcttgctaaaggtttgccaattttgttgatcttttcaaaaaccatcttttgcttttatagactttattgttcttctgttatttatttcatttttttctactttcatatatttttcttctattctcatctttttttcttccttcactctgcttgctctgtgtttggtttccattttctggtttctgaggtgaaaggttaggctactgattacaaatctttctccttttttactataggcctttacagtagtaaatttgcttctaaacatggctgttgctgtatctcataagtttttgtggattgtgtttttgtttacattcttctcaaagttaaaatttcccttctgatttcttatttgacctattggttattttggtgtgtgttgtttagtttccacatatttgtgaatttccctaatttatttctgtcattgatttccaattatgattggagagcacactttctttgcttttaattcttttaaatctattaaggcttgttttgtggcatatcagaaggtctatccaggagaatgttcccagtgcctttgagcggaatgcaaattctgctgttgttgggtggaatgttctctatatgtcacttcgatttcgatagttattgtattggtcagttgtacatctttggtgaattttttgtccactaatccaattaatgatggcaatagggtatggaatttccccaacgataattatggatttgtttctccctttagctctatcaacttttgtttcatatattttgagtctctgttttttgatacatccaaatttaggatcattatgtcttcctagtggattgattcttttatcattgtgttgtgttactttttgtctaaaatattttcctagctatgacatctcatttatctgatattaatataaccactcccactttctcttgtttttattaatgttcaaatgcacatttagacatcaaaattggcaagttattgtttaaggttaagtaacatcagtgacctttccccattcattactattgaaccccattggactattttatcttatgaatggatcttttgtccattcaccattttgtaacatcctgtacaggttgtttggaaaatactgatgccctgagtgagttgtgttgtttctgaatgatgacacttttccttatccaatactcaaaactcatgtttgctaatatcaccaccagtctcatggttgagctctaataaaattatttttctgctttttgatatttattttgtattgctttataacatgttaccataaaattagcaagttaaagtagtattcattcactcttataatttccctgggtcaggagtatgggtcctacgtagctgggtcctctgctcagtgtcttatacaaggttgcaattcagatgtcatctggggctaggggtcttgtctgaagtttgatattatattacttcatattgcttttgtaatgagttaccatgaacttgattgcttaaacaacataaacttgttattttataatcattgaggtcagaaatccaaaattgggtcttcctgggctaaaatcaaggtgctagccaggctccattccttttggagactctaggggagaatttatttccttgccttttcctgcttatagaggccacctgcatttcttggcttgtggttacttccttcatcttcaaagtcagcagtgtggcatcttcagatctctctctgactcttacctttgcttcaaatctctctctgactcttacctttgcttccatcatcatatctccttctctgactctcctgctcttcctttcccttataaggactcttatgattttgctggccccacccagataattcaggataatcacggaactcgcggctgcttccttctttactattggcaagtgtacaaaaatttctgctgcctgtagtgtcttctcagggaaggcgtaaaacccctcttttcaaggctgtacctggttatgttagaatcacccagaataatctcccttttgagtaattcagagtcccgtcaaagacatcttaagtgcatctgcaaaatccatttacctctgctatgtcataatctgatcacagcagttatatccagcctattcatgggtccctcccatgctcatgagtgaggattatgcagggtgtataccttgggggtgggaattttgccagccatcttagaattctgtctaccatgtttatctaggacatgcttaagtaagactggcattctctttcaactgccattgtatagtggtgaagaatctgatgactcctagtaccatttggtgccactgcctcggttcatgctaagggccagcaggtttactcattgttggttttgcaccacagtgcaagtgccaaccccataaaagcatgattatgaaaatagtttttcataatctatggagcccaggggtccttgaaacactctttgagaacaaccatttgtggagatgaccttacacagccatgtggcatcagtatgttttcattcaggtcagtgatgttttcgatatcagtgtacagcaatcatgtattgtggtgctacagcaggcaggaaggttgctttagatgtcttttgttgtatgaagctacaccttttcagttttacttctgtagaaagtaatataaattaatgcagccttttgagagggcagtttagtaaaatatttgaatgagcagttctacttcaaagcattttccctgtaggtatacgtatgcatgtgtgcagtggtacattttaaatgatgtttgtgatttcttgtgttttgtaccagccaaaaattaaacacccttaaatcccactagtgaaatatacagattctaaaccattcatactctgaagccattgcaaaaaataaggtagagctctggaactgacatgaaaaaggcaagtcacagaacaggatgtatgtagtatgaatcaatttctatcaaatataagtggatgtgagcacacacacacaggcctgcaggcagatctgaaaaggtacagagcagccccctcttgggatagatttgaggctgcctttttttcttataatctacaccactgggtattttttatattgagcaagtattacctttataataaaccttaaaaattaaagtgatctttactaatgaggaagaactctagattagaactggagaactagagaggcctttcccctcattgtttggatgagagggacttgtccaaggtcgcgctgcaagccagcagcacaactggcctgaagtgcagggatcctggctttaccttgggggccttttcttctacaacatgttgccatgagaagtgtctgcatagagaaggtactgatgacccaaaagacgagtttagggtcaattggtgtgctttggccaaagaaaccctggaaaatcctctattcatgaacaggtcaacctgccccaaagagttgttggaatacctcaaaatcaaaagtacaagctttgatatatagtgcctgctggtctgcttggcagctctcctactgaatggaagattagattaaaaaatctagaaagctgaaaaagggacttctctttaagaggtaagcacagtgcaataacagaaaagttgtaacttcagggccccaagaaaggtggtattctgtatactcatgtcaaagtgacagaactgtattatttgctctgtaaagatttactattgctctgtaaagatttgctatctggaaggttatcagtgttacacaaaccattggccataggaaggaacaagctttagttctctggaaagttgcctgtgtataccatctcattcctagatgttcttatccggtgtcatttttttttttgaggtgcagttttgctcttgttgcccaggctggagtgcaatggcatggtctcagctcatagcaacctctgcctccagggttcaagcgattctcctgcctcagcctcccaagtagctgggattacaggctcccaccaccacgcccggctaatttttgtgtttttagtagagacgggttttcaccatgttggccaggctggtcttgaactcctgacatcaggtgatctgcccacctcggcctcccaaagtgctgggattacaggcttgagccttcacgcccggccttctactgccatttttccgaagtcaggtctacatgatttgttgttttatttttagtgtcaattaatagatattcctgagtctctgcagaccagccatttgcatgtcagacctttttttgcatcagaaattaccttgataagcctggacaacttagcaagaccccgtctctacagaagatgaaaaaattagctgggcgtagtggtgcatgcctgtagtcccagctgctcagcaggctgaggtgggagaatcacttgagcctgggagttctacactgtggtgagctatgatcgtgccactgcactgcagcctgggtgacagagtgaaacccagtctcaaaaaacacgaaattaccttgatgctcaaatcgtggtaatttgacttttaattttgaggtaattgtaaattcacatgaagttgtaagaaataatacagagagatcctatgcaccccatacccagtttcccccagtggtaacatcctgcaaaactatagtataagatcacaaccaagatattgacattgatatagtctggtgatcttattcagatttcctcagttttacttctactgagtgtgtgtgtgtgtttacttctatgcagttttatcacttgtgtgggtatgtgtatctaccatgacagtctagacagaactatttcatcaccacaaagatccctcttgttgcccttttataaacacagacactccctcttgccacccactccttgcctgtctctaacccctgacaaccattaatttgttctccatctgtagcatttggcaatttcaaaaatggaatcacagagtatatactgttttgggactggcttttctcactcaacataattcccttgagatccttccgagtcaccgtatatatcaataatttgttgcttttcctcactgaacagtatttcatggtgtggacgtaccatagtttgtttaaccattcgctttttggaggtcatctgggttgctcccagtttttgactattataagcacttacatacacgttcttatgtgaatatgactcttcatttctgtgggataaatgctaagttgtgtgagtgctgggttgtgtggttgttataggtttagtttgttaagacattaccaacatatttttgtggtgagaacattcaagatctactctcttggcaatttttgagtatataatatattattattaactatagtcaccctgctctataataaatctccagaacttattcctcctgtctaactgaaactttgcaccctttgactagcatctccctactccccaccccagcccctggccaccagtattctgctctatgcttctatgagttcagttttggttttttttctaattttctttgagttgtaaagctgggttgtttatttgagatctttgtgtttgtttgtttgtttgtttgttttgagtcggagtctcgctctgttgcccaggctggagtgcaatggcgccatctcaggtcactgcaacctccgcctcctgggattacaggcatctgccaccacacttggctaatttttgtatttttagtagagttttagttttatttttattttgttttatttaatttaatagagacagggtctcaccatgttgcctaggctggtatcgaactcatgtgctcaggtgatcctcctgcctcggcctcccaaagtgctgggattacaggcatgagccaccacgcctggccagattttctatttcttcttgggtcagcttcagtagtttatatctttccaggagtttgtccatttcatctaggctgcccaatttattggcatacttttgtcaatgatattcccttaaaatccttttttatttctattaagtcattagtgatatcctctctttcatttctcatttcagtaatgagtcctctctctttttctttgtcaatcttgctaaaggtttgtcaattttgttgatcttttcaaaaaccatcttttgtttttatagactttattgttcttctgttacttatttcatctgtttctactagagatggggtttcaccatgttggccaggctggtctcttggccaggctgttctcgaactcctgacctcgtgatctgcccaccatggtctcccaaagtgctgggattataggcatgagccaccgtgcctggagagatctttgttttttgtttaggttggcatttattgctataaagttctctctcaggactgcttttgctgcatctcataagttttggtatgttgtgtttctatttttatttgtctcaaaaatttttttgatttcccttttgatttcttctttgacccgttggttgttcaggagaatgttgttcaatttccacacatttgtgaattttccaattctctgttcaaacttctagttttgtaccattgtgggtggaaaagacacttgatatgatttcaatcttgttaaatttattaagaccttttctgtgacctaacatgtgacctatcctggagaatgttccatgtgtgcttgaaaagaatgtgaattctgctgctgttggatagaatgttttgtgtatgtctgttaggtccatttggtctagagtgttgtcctggcccgctgtttccttattgatttttctgtctggatgacttgtccattgttgaaaatggaatattttcatcttcttaaacaggtcttttacagaggaaatgttttaattttcacaaggtggatgtatcaatttttctttttatgaaacgtggctttgttgtcaattgtgtgaactctttaccaagctctcagtcccaaagattttttttatgttttcttttgaagtttcataactttatatttaagtaaagatgatcatccattttgagctcatttttaataaggtgtgaggattaggttgagattcattgtttttacctattgatgcccaattactccagcaccgtttgttcaaaagactatgctttatcaaattgcttttgtacctttatcaagaatcacttgagtgtatttggggtctttttgggctcttcattctgtttgattgatctgtctgtctgtccctctgccacagtcctgattactataactataaattcagctttaatattggttagagtgatttgttccactttattctgctttgtcaagttcttttaaggttcttctagggcctgtgccttttcatataattttagattaagtttgtctttgcctagtctagaaaaaaacttactgggattatgataggatgtgtattaaacatagatccattttgggacagttgacatttttactttgtggagtcttctaatccatgaatacggtatgtctctcaattgatttatgtcttctttgatgtcttttcttgagaacactgtaaattttggtatagaggatccggtacatgtttaaatgtatgtttaaatattttcttttctagccgggcatggtggctcacgcccgtaatcccagcactttgggaggccgaggcgggcagatcacgaggtcaggagttcgagaccagcctgaccaacatggtgaaactctgtctttaataaaaatacaaaaattagcggggtgtagtggcacgcatctgtaatcccagttactcaggaggctgaggcaggagaattgcttgaacccgggaggtggagtttgcagtgagctgagatctcgctattgcactccagcctgggcgacaaagtgagactctgtctcagaaaaaaaaaaaaaaaaaaaaaaaaaaaaaaaggctgggcacggtggctcccgcctgtaatcccagcactttgggaggccaaggcgggcagatcacgaggtcaggagatcgacaccatcctggctaacacggtgaaaccccgtctctactaaaaatacaaaaaattagctgggcgtggtggcaggtgcctgtagtcccagcgactcaggaggctgaggcaggagaatggcgtgaacctgggaggcagagcttgcagtgagccaagatcacgccactgcactccagcctgggcgacagagcgagactctgtctcaaaaaaaaaaaaaaaattgtcttttcttttttttgagcctgagtctcgctctgctgcccagactggagtgcagtggtgtgatcttggctcactgcagcctccacctccctgactcaagcaagattctcccacctcagcctcccaagtagctgggactacaggcacataccaccatacctggctaacttttgtatttttagtaaagatgggatttcaccatgttgcccaggctggtctcaaactcctgagctcaggtgatctgcccactttggcctctcaaagtgctggcattataggcgtgagccaccgtcccatcctaaatattttctttggagcaattgtgaatggctaattttgggtttgatatgttcactgctatgatatgtgatcaatattgttgaacttgtatcctgagaccttgctgaactcacttattctagaaattttttgtagatttcttggaattttctatgtacatgatcatgtcatctgcaaatagaaacatatatagttcttcctttccaatctgtatatattttttcatattgcaatgctagacatttcagtaccatattaaataagagtggtaagagtgatgtccttggtgtttcagaccttaaagaaagagcattcagtctttcaccattaagtctgacgatagctataggtgttttctagatgttctttatgaagttgagatagttcccctttatttctaatttgctgaaagtattttttttccataaatgagtgttagattttttcatgtccattgatatgtgatttgtcttctttggcctgttgacagggtagattacgttgattttcaagtattgatccaacttgcctgactggaataaattccatttttcatgctgtttaattctctttatacattctattctgtttgctaatattttgttgaagatttggcatgtaaattgatgagagacattagtctatatgttttttttttctttaataaggtcttgatctggtttggctctgtgtccccatccaaatctcatctcgaattgtaatccccaggcatctagggagggacctggtggaaggtgattggatcatagggatggttccccatgctgttctcacgatagtgagtgagttctcacaagagctgatgatttttaaagtgtttggcagttcccgctttgctcctctctctctcctgccaccttgtgaagtgaagaagatgccaatctcccttttgccttccactatgatcgtaagttttttgaggcctccccagccatgaggaactgtaagtcaattaaacctcttttctttataaattaccctgtctcaggcagtatctttatatcagtgtgaaaacgaactaatacaggtctttatctgtgtttgttaccagggtaatactggccttacaaaatgagtggggaagtatttcctcttgtctcctttctggaagagattgtatacaattggtgataattcctttttaaatgtttggtagaactctccaggtaaatcaccaagtcctggaggttgaggttttgtttttttggggtttttttgtttttttttttgagacgaagtttcacttttgttgcccaagctggagtgcaatggcgtggtctcggctcactgtaacctccgcctcccaggttcaagcaaatctcctgtctcagcctcccgagtagccgggattataggcatgcaccaccacacccggcttattttatatttttagtagagacagggtttctccatgctggtcaggctgatctcgaactcctgactcaggtgatccacccacctcggcctcccaaagtgctgggattacaggtgtgggccactgcacccagctgagttttttattattgtggtaagtatacatataaaatctactgttttaaccatttttaactgtattattcagtggtacttagtagacatttgtccctcctttagtatttgctgggcattggttctgggaccccctgcaaataccaaaatcctttgatgttcaattctctgatatgaaatggcatagtatttgcatgtaacctacacatatcctcccatatagcttaaatcatttccagattacttataatacctaatacaatataatgctatgtaaatagttattatactgtattttaaaaatttatattatttttatagttgtattattttttgttttttgttctttgaatattttgatccatggttggtcaaacacatgattctggatgtggaacctatggatatggaggatcatcggtattcacaatgttatgcagctgttaccatgatcatttccaacagtttttcatcagcccagctagaaaccctatacccctacaacagtaactcctcatttctccttactcctagcccctggtaacctctgctatactttctgtctctaagaatttgcccattctaggtacctcttataagcagaattgcacaatatttgttcttttgtgtctggtttatttcacttaatgtaatgttttccaggtttatccatgttgcagcatgtaccagagtttctttcttttaagcctgaataatattgcattatatgtatataccatattttgcttatccatttatatgttgatggccatttgtgttgtttccaccttttggctgttgtgcataatgctgttaggagcattggtgtacagatttctgttagagtctctgctttcaattcatatgggtatggacctagaagtggaattgctggatcatatggtaactctgtttcacattttgaggaagtaccaaactgttttccacagcagctgcaccattttacattcccaccagcaatataccagggttccaatttcttcatgtcctcaccaatacctgtaatttttcatttttcttttaataatagccatcccaatgggtgcaaactggtatctcattgcagtttttatttgcatatccctaatgactagtgacactgagcagcttttcatgtgcttattggtcatttgtatatcttctttgaagatatgtctattcaagtcctttgcccattttaaaaccacttttttggtttttttcctttttttttttttgagacagggtcttgctttgtcacccagtctggagtgcagtggtatgatctcagcttactgcaacctccatctccgggctcaagcagtcctcctacttcagcctcctgaggaggtgggactacaggtgtgccaccacacctgtctaatttttgtgttttgttgttgtttttttttttttggtagagacagggtttcaccatgttgtccaggctggtcttgaacttctggactcaagtaatccacctgcctcagcctcccaaagttctgggattacaagcatgagccactgtgcctagccttaaaatcagggtttttgttgttgttgacttgtataagttctttatatagtatggatattaatcccttattggatgtaagatttgtaaatattttctcccattcttgtgagttatctttttactctcttgatattgtcctttgatgcacaaaagtttttaattttaggctgagcatggtgcacatgcctataatcccagcactttgggatgccaaggcaagtggatggcttaagtccaggagtttgagaccagctttgccaacatggggcaaccctgtctgtacaaaaaatgcaaaaattagctgggcatggtggtgcacgcctgtagtcccagctactcagaaggctaagataagaggatcacttgagtctggaaggcggaggttgcactgagtggcatgattgtgccactgcactccagccagcctgggtgacagagtgagaccctgtctcaaaaaaagttttaaattttgatgaagatcaatttatttattttgtttttgttgttgatgttgcctgtgcttttgtatcatatccaggaaatcatcatcaaatccagtatcatgaaactttttcataatattttctcctgagagttttatagttttagcttttatatttaggtctttgaactatttctttttttcatgccaccatgtctaagaatcttctatctattttgagttaatttttgtatgtagtataggtcagggtccgaagtcattcctttgcatgtggctatccaattttcccagcaccatttgttgaaaagactgtcctttccccgatcgaatggtcttgacatactgttgagaatctagtgaccgtatatgcaagggtttatatctgggcttgctttcttccttccttcctcctttcctttcccttttcctttcctttctcccctttcccttccttcccttcttccctccctttgttctcccaccctccctccctccctccctcccttccttccttccttccttccttccttccttccttcctttcctccctccctccctccctccctcccttccttccttccttcctttcctccctccctccctcccttccttccttcctttcctccctccctccctcccttcctgtgttctgtcctccttctcctccttcttctccttctccttcttctccttcttcttcttctttttttttgacggggtctcattctgtcgcctatgctggagtacagtggtgtggtcacggctcactgcagcctccacctgggctcaagcaatctttctatctcagcctctcaagtagctggaaccacaggtgcacgccaccacacctggctaattttttgtattttttgtagagatgggatttcacaatgttgccaggctggccttgaactcctgggctcaagcagtccacctgcctcagcctcccaaagtgttgagataacaggcgtgagccactgcacccggcctatttctgggcttcctattatatttcattggtttgtatgtctgttcttgatgtcagtaccacacgtgttgtgatatttgtagttttgtagtaagttttaaaatcaggaagtgtgactcttctatgttctttttctagattgttttggctgtttgagattccttgaaattccatgtgaattttaggatgaatttgtctatttctgcaacaaatgtcattgggattttggtagggattccattgaatctgtagattgctttagatagtatgcattgccattttaacaatttagtgtcttctaatccatgaacacaggattaggttgtattttgatagttggtggtttttgagaaattggtccatttcttccaagttgtcaaatatgtgagctaaaaaatgttcatattattccattattattcttttaatggttacaagatctacagtgtcccatttcagtccttttattggcatatcatcttttttaacttttatgtttgttagtaaggctagcggtttatccctttttactgtataaataaacttttggttttattgatttttttttagtattgcattcttattttcagtttcatggatctctgctcttgtgtttattttttccatctgcttgctttggttttgtttttctagtatctagctagcttctttttctagcatcttgaattagtaacttagattattgatttgaggctcttcttcatgtctaacttatgcattgagtgctataaacttctctctgcactgctttagatcccacatattttgctatgttgtgttttcattttcacacagttctatgtattttttaaaatttcctttgaaactttttctttgacccttgttttatttagaaatatgttgtttaatatccaaatgtttagagattttcttgttttctgttgtttcttctctgtttctaatttgaattaagtataatcaatgatacctctctgcataatttcaatacttttaaatttgttgaagtttatttcctggttcagaatatgatctcaggtgaatattctgtgagtgcttaaacaattgtttactctgctgtaattggctggtgtgtcctgttgtgccaattaaatcccattggttgattattgttcactccttcaatatccttgtagattttctgtctagtagttctaccaattgctgagagtggagtgttgaagtccccaactataaatgtgcatttgcttatttctccttttagctctatcaggttttacttaatgtgtctagacactctattgttaggtgcacacacattcaggattgttacgtcttcctggtggattgatccttttatcattttataatatccctcttcattccatctgagaactgttgggttatgacttgacttactgtattgtttttgtattttctttgcagaagattcagacctacatttctttgatccacagacaacaccaaaggtctatcgaaaaatgataggcaatacattttaaatgtccctaggcagtttggatatcacattattgctctgtaaaactcatttaggttttttccccagatacatcgctgtttctctcccaggtgcttgctgtatacagcactgtctctgtcttttccctctattaacttcaatagtgggaacagttacagcacagtcttctgaagttcaagagaagaatcatttggaaaattcatgaatgccatctgtgtaattggtgtgaaagaagtccatatttgaaaggaatctggttgagcccagagacctgatgtttataatagtaaccacagttatataaaattatatatgtgtgtgttgtaagcactttccgtgtataagatactaccacagtccactgggaatgcatcctcaatctgtccatccctgggcaggattagctatagttcaagtgccaggttgacagtggtggaaccaaggcttggagctcaagctctagaactcctcggtccatgtggtcatctcccgcagatctgggctcaagtcccagctttgccacttacctggccacatgtgggactatgtctgcctcataacccccatcccctgaagaaaagtgaacagaacccacctcatttaagccttttatatctctttgtcatccgtctcaaagtgattctgcagaggtcctataggagcctcaaggaccaagacaagaatattcatgatgtgacttccctgagccatgaatggctgctgcattttgttcctaaatgtgctccctttgctgtcctcccttccccttttagagagatggaaccatgtaaccaccacgaccaagaggccagtaaccaccagagctccagcaaatactttaggtaaggtggccgctctgaggagagtagtaaggcaaggatcccatggggctccctctgagacaggatccaaatgagctacccatagatgaactaattgagtatttcttttattttgggaccccatgaaggaaatgattttgacttggctgatgccctggatgatcgaaatgatcgagatgatggccgcaggaaaccaattgctggaggaggaggtgagtcccacctggtctggttctgtctcattaattacatcatcccacagagccagagccagcttgggcctggcagagctggaggcacttcaagccactggagaaccctataatggtggtactcaaacttttttggtctggggactcctgaaatcattgagatctcaagagagattttgcttatgtgggtcacgtttatcaatactcatcatcttagaatttaaaactgaaagactttattaatcaatctaaaatgaacaacattaaacccatacatttaacataaataacatttttatgagaaataactatgcttggcaagacaaaaacttgtattgaggagagcggcacgctgttacatttttgcagatttctctcatgtctggctggatggaagcagctggcttctcacaggcactttattccatcgtgagatgttgttttggttgaagtatatgaaggaaatctggcctcacacccataggcagtggggaaagggaggaatattttcacagacttttcagatccttgtggataatcttctcggataggacaccaaaacttggccccaacaaaagcggttgtttgttacaggttaagcgtagtgtggagtgtgaaactcttatcagtgaactttccacacttggttccgtgggactatcttgtcctttcagtggaccttttacccgttcataaattttctgcttccttgtgtcagtttccttgctgcataacaaaaatcagaaactctgagttaaggcaacacccatttattatcccactgtttcctttggtccggagttgaggaacagctaagctgagttttctgctcaggagctcatatagctgcagtcaaggtgttggtgagggctggggtctcgtctgaagttgggttcccttccaagctcaattgcttgttgacagtacattcccttgcagctataggaataatgactgcttgctgcttcaagactagcaggagaatgaccaacagacgggttggtagggggagaaaggaggagagaccgaccgactctgttgcttctcatgtctgagctcagagaaggcctgaacctgcttttgaggatgtcacctgattaagtcatgcccatctaggataatctcctttttgatgaatgcaaagtcaaattgatttggtaccttaatcacctctgcaaaatcccttcacctttggcatgtaatctaacctaatcacgggagtgatatagccatcctatccatggttccactcacactcagagtggtgggacattatgcgggacatgtacaccagtgggagggggtctggggggacctcttagaatttcatgaagggcattcttaagtggaactgggaatcattttctgaattttgggcaacattagcacaagtttcttgttgctgatttttttttcttgttgttgaaatgtatgttttattttctccaggtttttcagacaaggatcttgaagacatagtagggggtggagaatacaaacctgacaagggtaaaggtaggagcattgatttgtgccaacacaacccttattctggtgaaaaaggtgattatgcagcaaccagattaattgagcctctgggaaatgagtggtagttcccagacatcccagcctgccagttggggttcatttggaatgatgtgagccatgcagttcaagggggggatttataagccatcttggaaaagccccacatttcccctgatgttccttaagcagcagtgctgataggttaacgtttcatgctggctgaagcctatttgccaaggcaacaccaccaatgataataactgggggccagtggactctgaaagcagccctctcaacctcaagagactcactcactcttgggatgggaggagcaaagtcatcatgacgagcattttttttaagagacccatagcaagtcagatatcttttaaaatacctttttattttgaaatggttctcacaagaagttgtaaaaatagttcaagagagttcatgtgtatacttcacctagcttctccttatataaccatagtcattgtcaaaaccaggaagtcaacattagtacagtactgttaagtcagctacagaccttgttcagatttcatcagattttgcatgcattcagatatgcgtgtgtgagcgagtatgggtaggtctataaaatgttatgtgtgtagatttgagtaaccattaccataattagcaggcagaactgttccatcgccacaaagaagttccctcatgttaccccagaatagtcatgtcctccccaaggccagatagtgttaattccccaaactaccaaagatttcaaccttttatcatagtatacatcaagtctggagggaatattagccagatttgttgatgtggcaaggcaggctagtgattgtaacttgtggttgtaacctgtcgtgattgtaacttgtgattataatctgttgtgatagcaacatgttatgatggtaaattgtggtaaccctggttgtaacctgttgcaatggcaaattgctgttacacccggttataagtgtgacaagttatgggtgtatctggttgtaactctgatacactccccacagtcttggctgtggttactagtgtttgctcttttcttgcaagaacggtgtgcctttcgtatgggaatagtgttctcttccgattaaaggataccatggttaaatttatccttcgaaacacctttccagacagagtcatctctactaaaaagcacaaaaagcctctaaatgaaacctacaggtgtcaggataacatggaacatttaaagggcaaatccagcaaattagccaattacttctgggtgataagtggtatttccagatggtgaaatgagagcagtaggcacacgtgtaagcacacacatgaatgaaagtctgaatggcatgtcaggggcttttccttattaaaagtgcatgttttagcaaggaagaagtgttcaggaattctttaattaggctcatatttgaacttctcttgtaaagaataatcaattgttagcttaagttataccctctgccattataggtgtcaggaaaagaagataaagggggtcgtggaaaaaaggacaagtgtgaaactgaaacatggttatgataagcacaccatggaattctcagacactgtcctttacacaaaaatatgctaatgctgtgagcaaaggtaaaacatcacatttcaataaattatgatcttcagcatgaaaagaatcctaattaatgcatttttcaggcttgggtcttaggcacatagattcagctacattttggagtgtatttttgaaacaatacattatttgttatggattttttttctcaggaagacctcttaccctgtagaagccccacattttgcctataggtaacgatgacagtcttttgtcaacaggtcctattgcctttctctaagaaggtgatggcctataagccctcctcctccgcccttatttccttcctgcccagcctgggcaggactctgattgtcccccatttctgccaacagactgctttccatagcactttgagaaatttgaggccaatgtttcaactcctcatggcccccctgccatgtataccctagagtatgcaagcccctactcccactgtggttcccaatggcttcctgatggtcacagccctctgtcctgtgtggcctctgtagcatttgactttgatgatcaccttctccttaacattctttcctcctgggccctttctcactcattgactggtctcattcatgagtctcattcactgcttctttctgaacactgctgcctcttggatttatttccttggtgtccaattctgtatgtcattctctttcactgggaaagagaatggtattagaaaccaagatctgagtattcattgcttagtggtatatcgctacttctagactgtctaagcagacagagataggaaataggaaatatatgtatatatactaacccatgtgtcttacttcaggctgctataacaaattaccacagactgggtgataattaagcaacagacatttgtttctcacagttctagaggctgggaagtccaagaccaagtcatggatagatacagtatccagtgaggatctgcatcctcttttggagatggctatcttcttgttgtgtccctgattggtggagaggacagagtggggagaaagctctggtgtctcttcttataagggttctaatcctatcatgaggggtcgaccttcattacctaattaactcccaaagaccccacctcctaatatcatcacattggaggttaggacttcaacatatgaccttgagagacgggatacaaatgttcagtacataacaccatatatatacacatatccaaaataatttcttttaaccgtcagcaggtatataacctaaacatgacttcatacttatatctccaactgtaatccagtgccagaaggattatttcgatcttcctttctcacttacctataactttcctctctgacagtgagacacctagctcctactacccgtcattcatttactgtcttactcaattcaggtatacacgtatagagcatcagaattgctaactcatacccccaggagaaacaactttaccaactagagtccagtgtttatgttcagtttcttttgtctttaccttacagttcccagtcaaaatactgtttttcaaagttacttaggtcggttcctttaccttcctcatccattcagtacagtaatgccacccatttataatggagttagattcatttgtcatagtctgcattccatcctgggagtcccccacccacctggttgatgttttgttcttctgcttgtaggcattaaagttcactctttgtaacatatagttctgtgggttttggcaaatgcatagagtcacatgtccaccacccaagtaccatacagaacagtttcttcaccatgcaaggacttctgtacatgcccttgatagtcagccactcccccttccctcaaccctagtctagtttctattagcgcaaccactgatttgtttacttctctgtggttttaccttatccaggatgccatagaattggagccatacagtatataggcttttcagactagcttctttcacttagcaatatgcatttaaagttttttcatgttttttcatagcttggtagtttgttctttttagcattgaacaatatcccattgtatggatgtaccactttgtttatccattcacctgctgaaggacatcttggttgcttccagtctggagtgaatatgaataaaactgctataaataaaacttttttttgagataggatctcactctgttgcctagcctggagtgcagtaatgcaaacacagttcactgaagcattgacctcctgagctcaagcaatcctcccacctcagcctcctgagtatctgggaccatagatacgcaccaccatacttgactaacttttaaaatttttgtagggatggggtcttgctatgttgcccagggtggtctcgagctcctgggctcaggtgattcttctgccttggcctcccaatatgctgggatacacgtgggagccgttgcgcccagctataaacatttttaaacattacatacaggtttctgtgtagacatacacataatactttatacttttgttctatgaacaacactatgaagaaaagaaaaagacaagccacagatttggagaaaatatttgcaaaatcatatacctgataaaggacttgtattcagatgatataaagaattcataggccgggcgtggtggctcacgcctgtaatcccagcacttctggaggccgacgcgggtggatcacgaggtcaggggatcgagaccatcctggctaacacggtgaaaccctgtctctactaaaaatacaaaaaattagctgggcatggtagcacgtgcctgtagtcccagctactcgggaggctgaggcaggagaatcgcttgaacctgggaggtggaagttgcagtgagctgagatcacaccactgcactccagcctgggtgacagagcaagactctgtctcaaaaaaaaaaaaaaaagaaaaaaagaattcataaaagtcaacaataagaactcaaccccaattttaaaatgggtaaaaaatatgaagagacttcaccaaagaagaatataaaataggaaaataagatattcaacgtcatttctcactagggaaatacaaatgaaaacaagataccactatgcacctgttagaatgtctaaaatccaaaaagctgataatatcaattgctgatgaggatgcagagcaacaagaacgctcattcattgtttgtgagaatgcaaaatggtacggccaccttggaagagagcttgacagtttattgtaaagttcaacatagacttgccatatgacctagcagtcatacactattgctggtttttgctccggttgaacagtctgccgacagacttagggaagggaaaaatgagagcagcctggggtaaaaatgccgtggactcaagctgtttttactgaaatcaaatgactttcctgaaatgactaactttttgtccaggtttatagttgctttttgaggagaggatttgttgatctccttactgtctcatgccagaagtctcttccctggtatcttttgaatctagattattctttctctttatctcccctcaagcccaggccatcttcaccctcccttgggatgaccagctaagcggttaagagtgttgaccttaaccgcttaactggtatctttgctccagcttgtcctccttgcagccgcaagagagaaccatcaagaacatgaatgtgaccctgtcattcctctgtttaaaaaatactgtgtaacaatgaaaagacaaacaatccaattaaaaaatgagcataggatttgaacagacacatcacaaaagaagttacatgatgttcaaaataatttatgtgtgttgaaccaatcttgcatcctagggataaagtctacttgatcgtgttggattagctttttgatatgctgctggattcaatttgctggtattttgttgaggatttttgcatctatgttcatcaatgatatcagcctgaagttttctttttgtattgtgtcctgctacagtaaccaaaacagcatggtactggtacaagaacagacacatagaccagtggaacagaatagagaacatacaaaaaatgcctcagacctgcagccatctgatcttcaacaaaattgacaaaacaagcagtggggaaaggactccttttatatatatatatatatatatatatatatatatatatactttaagttctagggtacatgtacacaacgtgcgggtttgtttcatatgtatacatgtgccatgttggtttgctgtacccattaactcgtcatttacattaggtatatctcctagtgctatccctcccccctcccccaatcccacgacaggtcccagtgtgtgatgttccccaccctgtgtccaagtgttctcattgttcagttcccacctatgagtgagaacatgcggtgtttggttttctgcctttgtgatagtttgctcagaatgatggtttccaactttatccatgtccctgcaaaggacatgaactcatccttttttatggctgcatagtatttcatggtgtatgtgtgtcacattttcttaatccagtctatcattgatggacatttgggttggttaggactctttattcaataaatggtgctgggataactggctggccatatgcagaagattgaagctggacccctacctttttgccatatgcaaaaatcaactcaagatggattaaagacttaaatgtaaaacccaaatctatgaaaaccctgaagacaagctaggcaatactattctggacataggacctttgtcagaaggcaaagtcttcatgacaaagacaccaaaaacaattgcaacaaaaacaaaaatccacacatgggacctcatcaaactaaagagcttctgcacagcaaaagaaactatcaacagagtaaacagacaacctatagaatgtgagaaaatatttgcaaactatgcatccaacaaaggtctaatatccagaatctataaggaacttaaacaaatttactagcaaaaaacaaaccatcccattaaaaagcgggcaaaagacatgaacagacttttctcaaaagaagacatacatgcggccaacaagcatatgaaaaaaagcttaacatcactaatcattagagaaatgcaaatcaaaaccacaatgagataccttctcacaccagtcagaatggctgttatcaaaaagtcaaaaaataaatgctgacgaggttgtggagaaaggggaacatttatgcactgctgatgggaatgtaaattagttcagccagcgttgaaaaaagtttggtgatttctcaaagaacttaaaacagaattaccatttgagccagcaatgccattatttagtatatacccaaacacaaattgctctatcataaagacacatgcatgtgtatgttcagtgcagcactattcacagtagcaaagacacggaatcaacctaagtgcccatcaacagaggactagatgaagaaaatgtggtacatatataccaggaaatactacacagccttaaaaaatgagatcacgtcctttgcaacaacttagatggagctggaggccattatcctaagcaaactaactcaggaacagaaaaccagataccacatgttctcacttataagtgggagctaaatgatgagaacacatagacgcatagaggggaacaacacactctggggcctatcaaggggtggagggtgggaggagggaaaggatcgggaaaaataactaatgaatactaggcttaatacctaggcgatgaaataatctgtacaacaaatccccatgacacacaatttacctgtataacaaacctgcacatgtacccctgaacctaaaattttttaaaaaaaaaaaccaaaatcattattctttggggaaatacaaatcaaaccaccatgagataccacaacacatcctccagaataactaaaatttaaaaggtagtatcaaatgttgatgaagatgtggagtgactgcagttctcatacatcattggtagggatgtcaagtttcttctaaagctgaacatagacctacctagcgacccagcaatttcattccctattcaagagaaatgagagctatgttctgcccgcttccaacaacaaaacaaaagacttataaaagaatgctcattgcttgatctacgatagcagaaaacacaaacaaaacttggaaacacccaggtatcaataggagaattgatcgacaaactgtgatacatttatatgtttattgcaatgggatgagttactgatacgacagcatggataaatgtcaaaaacaatatgctgagtaaaagaggctaatgaaaaaagagtacgtattatttgagcccaattatatgaagttccactacagccaaaactaagctataatgatagaaatgagatctgtggctgcgggggttaggtgtgtgaataagatcaactgggtgtcactttctggcatgatggttatgctctgtgtcttgataggggtctcggtttcatagttgtgtgcatctgtcaaaagttatccactggtacgtggaagatttatgtgtttcactgtatgtaagttttaccttaaaaaaggaatcgtaagcaaatgtaaaatgctaggtaaccataggttgaaggatactgatgtctgtaactttgacatgtgttacaaaaataagatcgattgacaagagggatggcagacgtgataaagtgaatgatgcaaaatgttaattacaggtctgcgtgctgggaatttgggtgttcactgcaagaagttttaaacttttttgtatgtttgaaatttttcttaattagatgttggtgaaaaaaattaaagaagcaggaacaacaacaaaagcctctttagtggttccccactgcttacgagataagttcaagccccttagtctgctgacatgttctttctgccctagaccgccaggttcctgtgatcttcaaacatggagaaaggccagtaggtacatatgccagtgcctgcagatgacattcctcggtctaaactgcttgccttccaccatgtaaattcccagtcatcctcaagcaagtgctaagttacccatgctggagatcccctcctctcaggaggctgcccccatctgtggtcctgtctccctgcccactctccgccctgcagcacagcttccatctcctgcccctgggctctcctagagcttctgtcactccgctggtacaggatagcacatgtcattctgaaccacagcgggtggtgtttatcttttttgcttctgctagactgggcttcctgtgtatccctgacacctccatgcaggtttgctggcatgaggactgtggagcaaacacccagctttgctctctgccttctctgtcacacctccctgtgaaggctagagtgatacttttgattggcgaagccagggtgagcctgctgatcctctgggccacattactggtgggatcatggcatgacctgctgctttctcctggaacctcaaaggagtgcgagagccagggcccaccacatcgctagctggggaagtgtgcactctcatagtaggtgaaccctgtgtctgctctataagcccagctttcccccacatgagctctgggatgatttttgtgagaagggaaaagggagagaagtaacacgtagcttctgtgtggcctcaggtcatgtcctctaactagtacacagaagccctgctcttgagggtgctgctgtactttagcctcttcatcaagcagatgccttacctttgatctttctctggctccttacatctgttctcagttggtaaagaacccggaggggaggagaagcggggaggggtgttattagcactcccggatcaccctcactggcctgttggtcagaagactcttgataaattaacacaaggaaccaaatgggggcaagggcactgctggctggggaaagaggccatttgctgctttcctttctccctatccccagaaggagagtcttccttctgtgctccttaaggatcccctaagcagtgtctactccgttgctcgggctaggtgttttaccctctccttcgttatctgcagacctttcccaaacttctgagtctgctcaaagctagagttttcgtgacagctctttcaagggtgccacttggagccttgggtggtacgaaatggatgtcttcacggtgagccttgtgtctgctccaagtgcgaaccctccatgcactgcagagaacaccagaaggagaggagcactacctgagcttctccttccgggtctaaaggtggaacttgctttgcagcacccagcatttcactgtactgattcctttttttggatcaccacctcctgcgtttagcagcccatatgctgggctcactcagctatacactgcttgttcataactactgtgggttcacagggctgaaacactgcctcatttttcttaatcagaaaaaaattattttgaaaatgttcgaatcaaattgggcacatttttacaccaagagggcatttttttaaaggccaaagcatgcagttcttaaacactgagccaagactaaaaaccctccttctaaagacatacaggcattctcttacccatgtgtctgggttgcatacagaggctatctggagatgtccccaagtgtgaagcgtgaacgccctcacttgtagttcacagggttaaaggggacggtactgactatgatcagttggttgactgtaactttgagtattagttccctccaaatgtagcctgttgatcccggttttatatatatagagagagagatatactttaagttctgggatacatgtgcagaacgtgcaggtttgttacatagttatacacgtgccatggtggtttgctgcacccatcaacctgtcacgtacattaggtgtttctcctaatgctatccctccccaagccccctacccccctaccccccgacaggccccggtgtgtgatattcccctccctgtgtccatgtgttctcatcgttcagcacagtgtcaaagttcatctgtgttgtagcacgcaccagcatttccttcctttttatggctgaatattccattgtgtggctagaccacattttatctatccatttaccctcttgggtttttgaagaaaacatttctcttccattttcactgtgtttacagtcattgtcttcaagtatctgggccctctcatgatccctttctgttatggactaaatgtttgtgtctcctgaaaattcatgtgttgaaaccctaacccccaataggatgttatttggagggtagggcctttgggtgacgtgaggtcttgaaggtggggtctttgtgatgggattagttctaagaagagatacctgagagttctcttctttggacctatttccacattcatttcagctttcataacatgtaaagaaataggatgtttcagatgtgaggaatagctccccagctctggtgttctgtgatgtgaagagacccacttgctcccttagactccccttccccaaacacgtacctgggaacacggcgtgaacatggcttttgtcctagatgaccaccttgctggtatctcaggagcttgacataagacaaggagagttttaagggtctgtatcagattggaaggggatacccattatattacctagagggagggcattcccatccctgtggtgggggatggataaaatctgggccttggagacttcctggaacagtgaggagtgccctccccagtggctagcataggcagccatgttttggtagatttttcagttcagtttgacttggtaactatggggtatttgatgcaagattttcttctctttgtttattcatttttttaaaagttgtttttattttgcactttggccatttttttagataatgaaaatacatttctaaaatatctaaaagccctagctatgtctattagaagagtctagaacacttatagatgtctttaaatacttgaacatctcccccagcagttataatcttcctaccattacgttactctccatgcccttggcaaccaggtgggtcaggcactcacggtgagcccaggttgtgctgctgtcagagaagggcagctccgtgtggtgcatccccgcctcccccagatgtatggctacgtaggaatcaaggctgccatgtatgcgtatagcattgtcttttgtctgtgagatgctgagggtctgacgcttcctttgatcgcagggcttattcacaactttctcagtgaggtcatgcctcctttctacagggcctctgtagctatggtggttgctatagctagagaggttcctatagctatgagacctgctatggcagtggtcactattgctacagtgacggtccctattgctatggtgtggctatagcaacggcagcagtccctagagttatggcagtccatacagctacttatatgcataggtatctatactcaaagcaaattgcagcatgtgatacactgtgcagggagacttctggtctactagaaagctactgtagtctctttggcatataattgtgaactcagaaggcaggtgggaatacaaaacatactgaaactgaagagtccgccagtgacctgtgaaattgcctctttgagctctctctccagctgtgggaaagaggggtggatagatttgcatggggcttgcagagttaaaacttcttacaaattacatgaaaaagacttgtttgttgtttcatgatccaggaagaatcactagtaatatttctgactgcgtgctcggagtactttttctatgcacaagtatatatttgtaaatatttgtgatttttaaaaaaataaaaatgggatcatgctatcctgaaaccatttttttcattcaataatacactgaatatcattctctgtcattaaagggtcttctaaaataccgtgtcagtggttacattatattatgatataccataatttatttcaccaggaccctatttttgtacagagattcccctcagctttttgctgctctgcacagtgctgtgatgaacattgtcttagccaaatgtgcacaaccctagtcagataacttcccagaagtcaaatggctgggtacagaaagcagacacttttaaagatgcgacactttgagtggtactgctgaatgatattccattaaggttgtgccaacctccatttccaccactagtaagtaaacaggtgcctgttttctcaaattatcacctccactgggcattatagttttgttatctttgcagatttgttcagagcaaaatgctatcctgtttaaatatgcatttctttgaatctaaaaggaagtgaaacactttttcaatgtcttattagacactcttaaaatattttgtgaattgcctgtttgtgttctttgcccgctttttttttttactggggtctgcatattttctcatttctgcatatttctgcatattttctcatatattttaaggactccttttacattagagattaggaagcccttatatattccataaacattttattcattcattcatcagttgatgaacctttgggttgtttatagcttttatgaatactgcgatgaacatgtgtgtgcacatttttatgtggacatatgttttcagttacctcgggtatatatctagaaatggaattgttagtcatgttgtaactccatgtttaacttcttaaggagcaatcaaactgttttccatagcagctgcaccattttacatgcctgctagcaatgtttaggggttccaatttcttcacatccttaccaacacttcttcctttctctccctctctcccttccccttgtcttctttcctttttctttttttggattatagttatcctagtggatatgagatggtgtctcattatggttttggtttgcatttccccaatgaccaacagtgttgagcatcttttcatgtgtttattggccatttgtatgtctctttggagaaacatctattcatgtcctttgcccatttttagattgaatgatttgcctttttattattgagctgaaggggtcctttatatattctcaatactagctccttatcagatacatattttgcaaatatgttctcctattctgtgggttgtcattctactttcttgatgatgtcctttgaagcacacaagtttttaattttgacaaagcccaatttagtttttcttttgttgcttgcacttttagtactgaagttttcacttttgatctgatcttttccattttcagtttctggctttaggatcatatttagaaagtcattttttaccccaagctaatagaaattccttacccctaaatttttctatagtgcttttacgccttcatccactttagttttactgggaactgatcttcacggatggtattgggttgggtaattttattttatgcccatgactcatcaccaataccatcttttgcacagtgtgcattttgtaaagtaacggggttcagcctgtgcctagaggaagtaagcgaagctcggtagcccagcgtggctcaaagcgatgacctcggcttggttaactccagtggcctgtgtggctgacttcaggttcatgcagtgagaaaggacagaaggatctaagatgactggctgttttttcttccagatgtttcttagcctcacagtagtttcagttcacatgcccatctgagaagacttgcccacaggatgggatcactttttttgaggaggaagagaagcacatttttgtcatctttttaggacaggacctccaacaatcacaaatggtcagataggaattgctggagctgtgaactattgagctttgagtctttttgaaagtctgggagagtcagcccttctgtccatttgtccctggggggaaattaggaaggggttcgacctgtttatgtttcttctcacagcctgttgctccgcagtcttgtgatatttaagttgctgggaatccttgtggccaagtactcctaagggaaaggagacctgagaacactcagtttccttctgccttgaggtgaaagaataggttgaattactcagagtccagaaaaatggaagtctagtgacatgaatacattagcagaggatgccatcacgacagccacctccagcatagcggaggggacctctctgttgatctggctgcacacagtgacccccatcttcctgttggttatgctttctccaacagcaatgattgtatgtgtgtatttttttgttttttttttgttttgtttttaatgctggtgctctttgttaataaccattcatatccaatcagggatctttatacactgcatagagctcaaggattcagccttaggtgggaacataacaaacctcatttttccccaggaatcttttatttatatatatatatatatatatatatttttttttttttattatactttaagttgtagggtacatgtccctaatgtaaatgatgagttaatgggtgcagcacaccaacatgaatctttttcttttaataggctttattttttagagcagtttcagtttcacagaaaaatagagaggaaggtacagagagttctcatgtttcccccacccccacatgtgcacagcctccccaactatcaatacccccccaccctgccagagtggtacatttttacaacccatgaacctccattcctcctgactctttgattggtgaaggaaatgttggagctcatttgccttcaatatcccagggcggtttcccctgagaaccccgggctctgggaacacagtctccctccattaatgagtgttcggccctgagaagagggtggcatgaacggtgaactcaacgctaattaaggtactgaaatggcaccagtggcttgtcagggagtagctgtctgtggaaggggtgcgtgcgtgtgtgtgtgcgtgtgtgaatttaaatctctgcagtactatcgtgtgtgatttgtgtgaccaccaccatagtcaatatacagaacagtctgtcaccacaaggctcctgactgttgctcatttataatcatagccaactccctccctcccaactctcaccagcccctgccagcattcatctgttctccatttctgtgatacttcagatccttttgaatttcaaaatagtggataagggattgtgagcctacatttgtttatgttccaagagcaacttcagctatagttgaggcagtggctacgtcagagacccgtggtggtggcactcaaagtcgggctgtcccggcacagcaccccaccccaccccccacttatggtgaggccgctagtgcagctgcaccactggtagcaaagaggtgaaatagaatactgtgtctaaagagcccggcatgtgaggcatgctcagggcaaggtggctgccattttaataataaaaagttccacctggtggcctgggctttgcaggtggtaggcataagaaagcaggcctcattgcagtccagtagaagcctacgggtgatccactggtgggggtcttgtcgcataggtgggattggaagggccagcactgccatccgtctcgcggaggcccgagctcgagcctgagctggctggtcgctggcactaagtgcttttgtcttttcttcaggtgatggccggtacggcagcaatgacgaccctggatctggtgggtttctgaatcctgaggctcctgttggccatgtgaaaggaaaatgaatctcaggaccccaaaatcactaagccaagggaaaagtcaagctagaaactgcatcaggcaaacgtgcctcccattctactcctaaataagatagctgcaaagatggaaaaagctgcacgcctccctcacaatttgcctacaaagaaatttcttatgggcctcaatatctttaccctaaaacagttctgtgaatttcaccctggcaatacaaactgatagctgatctttacagagggagagagagccgtccctctgctcccctgatacaaatgcatctctggttgcttcctctgcccaattgcttatgtaaaaatgcaggttcactgagccagacaaaattgtgtattcagtgaaaggctgatcaaggactcaaaagaatgcaaccttttgtctctttctcttatctccctatgacctggaagcaccccacctctacccctgctttgagttgtcccacctttctggaccaaaccaatgtacgtcttacacatattgattgatgtctcatgtctcccgaaatgtataaaatcagctgtgcccccgccaccttggcgcgtgtcgtcaggacctcctgaggctgtgtcatgggtgtgtccttaaccttggcaaaataaactttctaaattgattgaggcccatctcagatatttcacagcagctacaaggagacatagtgctgacccactctggtctcagagttggccttcccctgaacgtttccaatagataatcatgaggccaatagaggggtgtagccatttgaaggaaggaagcatgaagattggggtgccgggggaagtagcccagtgggaagcctgcagggcgtcagtcacagagagctctgcaccatttccgtgtctccctttcaagctcctcaaaagtgaagcccttacagaaaacgagaagtcctaggcaaatccaaggggcaccatgtctttgtaatgccgtagatctgtgtggcatggccctctcctgctggcttgggggttgggggcgtctagtagtttggtgctagaggagaagcaggctcccaggctgctccctgcggtgctttgtctctgacctcacctgtcctcatttctcccccttcttcacgcaggcatggtggcagagcctggcaccattgccggggtggccagcgccctggccatggccctcatcggtgccgtctccagctacatctcctaccagcagaagaagttctgcttcagcattcagcgtaagtgcagccacccactcgtggctaggaaccagctggcaaggtctttggagggaaaggggccaggacagatccagatccctccacagcctgcctgagacccactcccaagcagacttcctgggacgggggtggaggcaacagttttggaaatccctggggacagatctgggctgaattaaagtgtaaaccaccctgcaagagcgcgtggggctggccctgatgaccttcaccttccagggccccagctcccaggggtatttctgtggggacagagctcagtgaccactgtgatgtttccttcacgtagaatgggagggaccctggactgcacccatagcttcagacctcagccaagcggatgagggcctttggaggccctgcgtcaccagctccctcccatgctgctggctccctcaggagcagagggcagcagttcctgggggtttgcaaagcacggcccttattgctctggcagtgcccccgtcacatcgtgagaagtcactgcctggtgctcttccccctacgagccacaaactgtatggaatcattaattgctccaaagaagtaggaatgtgagagaaagaatggtgtggttcccccccgacccaccaccctttactaggtttttaaaagacagttttcatctcatgctgtagctgtgagtctggaagtcatagattaatggaatagttacaaatggaatcctgtcttcacccatcggcgccccacatcaggcagccctgtggggatgctgttgagggaacaagaccttgcttgtcccttttgtaagcacagatggatgctctgtcactgtttgctgagtggagcgtgtctccagttcaaggctggcaattttcagttcaagtgacagaatgtgactcagctgtagcttgtctctttccactccttccccggcccctttgatgcaatgggaagcttagaagcaacccacgtgggtctttccctacccttgctgtggccctccgcccttaagtctagcctgagctgagcttcccagaaaactaacctgggtcccaagatgctttacggaagtctccaactgtttattaatctgaccatcatatttgtttgcttcactcttgtagaacattcttgaccagggcgacacacacagcaggcacagcagtactgcaggagcacgttgacatgtcagtgcgcagcctgcgaaactgttcatggccaccctgcttgagatcccacggacccaccgtggatccggaagcttgactgtagagtggcatgagcagggaatgggtcagacagagtccagggctggggaatggattgtttttagagttacccttttccctcaaatcaaaaatcaaggaatcctctaactggtgaaaaagatgggaatccaaccttctaattgcctggacactgatatttagaaggagacattgggcgagagggtcgagttgcatttagcgcggcgggggaagttttgcatcagcctcctgggctgtgcctggaacaaggagcccagggcaaccaggtacatagtcacagcccttcatctctgaccgtgttcttattgcatttggcaaaaaagtagaagccgcctaatacaggggttttctgttcaagaggccccaaggctgtcctccgtgggctctccctccggcaggtggattggaacgagatggggattctgggacacagctcaatccacatggccttccccacggccagggatcctcatttgaaactgctctttgggctgggagctctccatactcgtctcccctccctgttttagaggagagggagcaaggacctggccagggacactttgggagaacaactcagagcatcccgcttgccaggagaggagtgaagattttggataagcatccaggttctcaaggtggcctcttgggaaaagataaaagcccagatttagattaaaccagatctgtaggacaaagttagaactgactgacagaaaaatctttcctgtatgactgactaaactagttggtaactaaaatgtcattgaacgaatatttattattaaaaaaaatcctacacccaaagatgtcctcaaaatggaggccacagtggcaggggaggtcctggtggctggctagagggcttctcctgtgtggacctttgctggagagcttatttggctggaagcaccatgtcagatacattttggcctgattttctgatgatttccccttctaggtggctggggtggcaaggaggtttggttcgtagcaacaaagtagttgtgagctctttgaacgaaaaggctaatgccctgggagccaaaaggtctcactggtgaggtttgccaaagctgtatgagttcactggggctgccagaacagagagtcacaaactgagtggctcaaaacaacagaagttgattctctcccagttccaggggactccggatgttccttggcttgtggccatatcattccaatctcggtttatatcctaaatccagaatgacctcatcttaacatccttaacttaattacacctgcaaagaccctgttcctgaataaggccatgttcacaggttccagggatgaggacacacgcagatcttttttggcatggggcggggcattcttcactatagcatcgtcagcctaatggtgagatgcgacagtccacagttttcacatccatgcccattacaaaactgggtgagatggccaggccaaaggatggctttgagactttaaaaagcatgctgggtaaaagaaactatttaaactacaggtctgtagttcctcgtaagagcagtgtcccgggcatcgtgcgcttgccagctacctgccattgcctctcttccgggctctgcacatgggtgaaaagccagccctgtaactcggcctggcaagggcagggccatggatggggagagttcttgggctgagcagacagggtggccggcttgggccctctcctgctgggccctcagtttccccatcaagggtatctcgacttccttctgctctggaattaaaaagtcagaggctggcttgaggctgctcaggtgtcagtaggaacagagagagaaaaataggttgatttccaaagcacaaagtgaacatcttgattgtatctgtctctgtgggacattaaaatgaaaggaaaatacattattttcatgcttatttcctaaaacgggccagtgtgaggttttgcgaattggatcagcaggcaaagcggggcagctcccaggaaccccgtcggcccagtgtgtccatcttggatttcagtgcccttcccctcccctccaaccttccttctcccatggcgccttcctgtgtggctgtctccccaagctagaggctgggagtcctcctgtccccccacctcatgtccgtgcattccccagtcctgggatttgtgccacctgtgtaggtctcctcttgagccacacctccctatcaccattgccatggcccctgccagtccagagccaaggtcttctcctcatctcccgtccaaaaggttccatagacctttttgcctgtgcagtctcctccacacctcacgctcctccagcgggacctgttttaaaatgcctggatcccccttatgcttcctgctgccctcaaggtcctggctgagcctgagtttggcagtggaagcccttcatggtttggtcccaaccacatcctttcccctccataggcttcccagaggcctttcacttcccgagggcgccaggtgctcttccatccccatcccgggcctctgctgtcccccgtcctgacctagctcctctcgccctgcaggcctggagcagcctctcccagcctgtggtcctacagcgccccctgctgacctcacctggtgctcatggggcgggattgggccggttggtttctgagtgtgcgactcccagctcgccttgccccctccgtgatcaggagtctctggaccgtccattccgtggcggggctgcgtgtacatcatgtccctggcacctggcccgggccagaatcaggaggagtcccgcagacgtttgtggggtggctgaaaacactgagaagctgggggttgggcctcctgtccccactctttcccctgagtctcagccactgccacatggagatggcggtagaggggaccggggtgcagaacaccaagctctggggagacagcaggaggtggctgcgaggaaggcctgcccccaccactgtggccctcaggtgctctcggcctctgctgctgccaaaaggcccatgctggggacccttggcttcccttgcctttgccctcagtgtggaaagcccgcatgtttgctgtcaggagcgctcttactccagggattctaagctttgtgtcttgccttcagatgcagcagcaggtcaaggtaacgctgctttgccttcctcactttccttttgcttcagccttgatgcttcctcattcgccccctgctctggcgcttccttgccgctcttctccctcctgcttccctggcactcaccgacgtggctgtaaccaggaccatctttagcttaccctgatgcgtgtgagaggatgccacctgccagacactctgtccccaggctggatgtggcaggggtggggggagagttgaggtgccatggtgaggactcaggtgcccactggtggtcatgcctggggagcacatagagggccacccacaggaaggagacgatccagcgcccactgggttggcagctagcagtgatcacgaggctcagggtgtgtctcctggcccccacctgtcagctgggaaggtgcacctggggcagcttccactgcactcatcacctgccccgctctgcgtggggccggccacacctgccaaagagcaacgcccgcatttgccacaggcccatttggctcccacctcaagcccagcagccaccggggcaggcaggtggtgggcattcttgtttaggcaaggagcctgtagcccaggacgatggcttgacttgcactggtgcctggtcggtcggtcggtcggttggaaccatgccccagttttcccacagacccggggctgaagggttccagtccctgtgctacgcagggatgagacacagactcttgactctctgcaagcagcagcaggggtggggtccactctaagaacttgaacactggcccttgctggcgggagggaatgcttggtacagtccccgaatccctcttgtaacaggtgtagagaaagcctagataactaactagactgaagcagctgctggtgggctggcccctccaagctcaggtggacacagcggttattcctgctgctgggaggagcagttggcctccgcgcgggtgttgctgggaggctgcatgttggcaggaggctttgctgcatctacatgctgagccccactcagccatccgcccctccctgccctgcatccatcaatcactcatagcgattggctccctggcccccgggccgcacacgcacacggacctgtggatggtgctgagccctgccatcgggcgccccctccactgggcggagctgccgtcttgacgcggtggcagctgccctatgaggatggagtgccggaagccttcgctgcatgtcgttgttatttctgaggacgatgatgagaactcctgggcagtgaattctgggacgaacagtcttcatccggataaggatgttcaggtggctcagggtgcagggttttgagttccccaggggagctgtgctgcttttttagctgcagaggacttggtcaggagttctcagtcacgattggggacccttaggtcctgtgcgcatcactaactctgcccttttccctttgcagagggtctcaacgcagactacgtgaagggagagaacctggaagccgtggtatgtgaggaaccccaaggtgagaactttgtactcactgtcccttgctgacgctttcctagttggtcccagcactgagcagaactgtgctagagaagcagggaagcacagaggcgtctgcttctagaatgtccggccagagcaaaagcctgccctgatgagcctgcctcccagtttcaggagcccaaagatgctggggtgacagccagggccatctgctgccatgcctgtgacttctgggcattgcggctgctcggcccctgcccttgattcgtccgtccgagccagagccccaggcacctctgctccccatcagcgaatacaattacatcctgaacagagccatggggaagcttttcacctagacctagaacttttccctttgcaaattgccacaggcaagagggaacttgggtaaaacccagaccctattgtcaacacctgtgcccctccctcccccttctgtggtcatcaagcactttctggattcaggagctgttggcaatttgaggtcgcataagttcaggccacaggcctagagtgcccaactgctcgaggcagatatgacctgtgcccacgggatgccaatgaggaggtccggaaaggcttgctggggtcggggagcagccgaggcctggtggcgcaggcagggagactaggacagctcaggcgagtgttgccagtggaactacagtgcagcagccgtggggactgggcctgggagaccaggaggggctcagcctgtgtggtgtgtactgggagccaggtgccctacaatgctgctgaagacgggtggcagtgctgcaccaaatgaactaaaataggcctgggttcagatgtggaaaaatggattccgctgtcgcatccactgtcatgagctttgccacggttagccaccacgaggccagcatctgtgtgggcaggtgctaggttgagccctttgtttaaaataacccttccagcagcgctggcaggaacacgctcattttttaggtgaggagatggaggctgagctgtttccagagcctgtccagctttctctttctctccccttgaccggcccaaaactgctcccaggctcaggagggaaggttgctaagcggccccccaggggatacaaagggaaacccagttctgttcccagcacgggcttgctgctgtatttgcttcttctgtgcaagacagagcagaattccttctgacggcctctttttcccctagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctatcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagcagattcttgtcttctgatggtgttaaggcacgcccttggtcaagtgttgccacttttccctaaagtaagtaatttatgatgcagagctgccctcctccccctccccccgccccgcccccagctgaaggtatttctcgagaagcttagaattcttgcatttacccctcagtgactggctcagtgtcaggacttccaagggtgactcctcaccgtacaagcagctaaggccaggggatgtggagcgaccaatgtcctggggttagagagggcagaggcaggagcagagtgctgcggggccgctcccgggctacatgggttgcgcagtccggggcctggaagcagcaaaaagtcccaggctcacaaatcccaagtcgactgctctgccgccttccaagcaggctggtaaccagtggaggttccagttaacgcgcagttgtttttcaaccagaaagctgggtgagaaaggagccctgcacctcgtcacttgttgcagcctcatggagagtggcccgtttgggatgaagtatgtccttctcatcagctcgcatgttggcttcaaattgagaagacgacagttcagttcagggcatttcagcatgaaaacaaacaagatgcagtggaccctgggttttaacatggaggtcggttgtttgttttttcattttgttttgccaacctcggcttctagtgaaataatagcatcaggtcctctcaaacccgagaccaccatatgcctgtctcgtgcaggagttctgcatggctagctgctatggtctcactgctggggaaggctggctggcaagcagtcccctgggcatcctctgtgcccagtgaataccgggctctctggctcactcagtagtaacgtgtgtggagagggacagggaccccacacccttaacaagaagaccgacaacacacagagggcacagggggtggtgtgatttcatccaggccttcgtggccctgaaaaggtgaacgccccttcctttggggtgggggcagtctgaggccttagagagcactgcacttgcatgcgaaggactcatcaccctgactggctcctctcaggtgtctccagacctttccccaagtcgtccacgttttctcaaggttagagctgagggcgtttctgactttacaatcatcaatcaatcaatcaatcaatcaatcagtatttcctgtttcagccaaaatacttacttacttacttacttacttacttaagactcatgatacatttacaatttactgaatgaattaaatcacataaagttagttactttacatcatcatatattaactgtgcttgacgcacagtaaacattcaatccatgttattttattaccgattttcctcaaaggaaaaatctactaagatacttacttacttacttaaaaaagaccagggagcaaacatatgatcattttaattacagatgattgaaatacagtgcaacagatgagacaaatacaatactgtaccagtttttaaaaacctgaaccataacggcttcgcattctagtacacttacttacttaaaacaaaaattgcttagataacaaaactatacttcaagttgttttagaaacagttctgcgctaggaacatacaaaggaaaatgacccgttgtgcttctttaaaatcgaatgagagtctcctctagggtcctgctgacagagccccccccagcctccgccaggtgaggtgcacagggcccactccaggcaccagctccccccaacttggcttctctggtttgtcgaaggcatcatccagtccacactatgtttaacagtcctagtcagccaggggattacatatttctgggaagaaaatggcaaatgtccccattaaaaaaaaaatcagtatatcaataatccagtatatccattcataaataagctttcagatatgttaggaacataaaagctattgttgaacacgacttagcaacaaatcccacatatgataaaaaatggagaattgattttaggttatcaaattaccttgaataaatctctctggtatcttcttatagaaggataattttccgtaagaatcaggaggttcccagttaaaaaaaaatccattctttctctctctacgaaaaaacccttaacatattttcaaaaataataaggtcaatctgtaggcctttgcctggaatccagtagtttgaaaccaaccagctaacactgctatgcagtcacactggggtttgacctcaggggccgctgcagctgcctctgcctctaaaggctgaattcctgcagccagtggcggggtgggggggcagctgcagcaacaggcacggcacatgggaggggcatggcctgctggggcaggacccaggtgtgcaatagtcatctgtggcatgtcacacagaggagctcagagctatggcgctcaagtggattgaaccaattggtaagttagttaattcctgcgagaaccgacggagtcacagagctcaaagtcagtaagtaaaggttcaggagcgggaagagagggctgaccagctgcggtcggctctgggaagggaaaaccaagggaagtgcgtgctatgcttttccaaaccaaagccacagcacggtggctgctttcaaatatgaacaggcagccacgcgagtaagctgagttgaaggaattgtgataaaatgagaaatgatttcatacaggcaaataacataagaacagacttgctttgatcccagcagctggctgcggtaaagtgggggtgggagacatggctagacagcccaggagcgagtgacaggcagtgctccttgaaggagccagaggccagcacctgtgcacagctgccagaggcctcggtttaccctcagcggggctggaagactgagcatggccgcttggtgccatccccatgaatgggctgagccgccccaagaggcgagtaccagagtgaggtgaggacagaacacgttgcccttgaaattgcaccacagaaaaacgagcatgaggtttgttggaaaagaatttctcccacagtacagttgagctgatcccccctcgggtgactattctaaacgtaaaaaaggacataggaaaataaaggcctgtttctcttctctaaaaataccttatatgtacacaacagtaattgttaacaggaggaccccgtgcatgaagaaaactgtggaacagagggcagtggcctgtcttctccccaagtacttcattcaagacagttttcaagttgtggccaagagctgagggaagccacggggctggcaatgcatcttgaagtgagtggtgtttgttgttactgaaggatttaagttggaaagaaatggcgtacagctttcttgaacctcagtactgcattccgttcacttagtttctcccaagctgcctgaatgccagaagttgcttcacagggtgggcgtgacagacggctcccctgtgaaaccgctgacaggagggtaacggttgccaacagtgggagctgtcacctagccacacaaatggtccctgggcctaatcctaaaagacaagatcacaagctacagccataacagtgatcgccaggtccctttcctgagccaccgggagacagtggagcagcaggctgacctcgcccatcagaccgaggtgtggacggaggtggcggagtgggagggcgaggagccccgctcagatgaggatgagacggcgcgcgtggccacctcccgctgtaggccctccacacgcttctgcagctccgccctgacggccagcagctccttgagattctggtgaatgggcatctggagggagcagagacaaagctgcattatcaggccatcctcctaccacagcgtttccacatggagatgctgttggcttcaggagcttttcaccatccagactcctggagcggccaaagtctcctgaggcgttgaccgatctcgcgtcaggtggacaatgggaccccatcccatgagctttggctgccactgaggccgccctgcagctccgggggccgagccgctgagccgggatgaaaaggcaccatggggaggctcccacagtttctcagaagacaagcaggcacggggacactgcgcaccatggatcaaccgagggcgccgtgtgcagactcggcacgagcagtgtcctaaagactgtgcgtcagaaatgtttccacgcagacccctttccagcatctccattatctctgtatttttgcatttttataaatagctctgctgactgaaaatccttctgttaaatcagcactttttacaacttgaagctgtgttttcatcaaccggagcaggatctgccagaagccccccgggagcgggcagtgccggcaggggggtggggagcctccccaaggaccaacccctccctccttgctcagcatcaccgcaaggcctcacctttaattagcttttctcttttaaacccatcaactgtggggcaggggtgaatataaacaagaaaggttttcccggggcatatgggacatccagtcctgctattttatagtcatagcacccaacccactcgcctaacaagctgtccccagcagctactaggaggccagacatccgagacccagcttttctcacctggagctctttggctgggggcaaggctgaccagagtgaggggtcaccgactgggctgagggagaaacagggtggggtctggggagctccctagccttcccttgtctctgatcccatgtgtaaacagcagccacagggctggctcctaagcctcagccaggccatgtgactggccacttaacaccttccagggacttcttccccctgccctgagaggggcctcgaggccctctgcagtctggccccagcctggccctctggctcatctttcaccaggtccttcccccactccctcaaagactgagctgttccaccgtgtgtgccaatggtgatcagccctcctggagggaagggggagacggaaggaggatgagagcgagaccgcaagggggcagccaggtccctctaataacaaggtgctcagtaaccagcacccagtgggctgagaagaaatgacccccttgggcaggccacaggaagaacagaggggacaggagtggagtgtgatggcaaaggcagatcccacaggcctctgggaggtggcaccagctcctctcttacccttaggacccatctggcatgcgttttcctgtctgtaggatcatttaattctgatcagacaagggacgccttgcaatcaagttcccattatccatctacaggcatgtgacctcagcaagaagcaagacacgcagggaaatacaccactgacacacacccagggcagacccagcactgctcaaacgcaccactatcatctcttcaccagctgtttgcatcttttctcacctatttcttttctttttctttttttttttttttttgaggcggaatgcagtctcactctctcccccaggctggagtgcagcggcacgatctcagctcactgcaacctccgcctcccgaattcaagcgattctcctgcctcagcctcctgagcagctgggattacaggcgcccgccaccactgtgtctggctaatttttgtatttttaatagagatgaggtttcactatgttggccaggctagtctcgaactcctgatctcaagtgatctgcccgccttggcctcccaaactgctgggattacaggcgtgagccaccgcgcctggcctactcacatattttcatttgcaacaaatcaagggcatgcctgaaggaatagaaaactcggaggcttaaacagaggattgtgttagagaaaattcccatctaagggccagtcatgtttgccgcatgggtactagcatcacaagacataaggcaagacagtcccaaaggaaataggacgcccctgggccttccacacccagccatcctctgatggatgcccaaagaacccctttctcggcagccaatcgagccactgccttctcagagaaaagaggcccaacaggcttgcatctgccctgtcgtttacccccctgcactccctcccctcccctctcttcctccttctctctgcctcacctggctcctcaggccctgtcactggacacccacaccagccactgatctctgcctgtcttcaatgcactcccccacccccattcccacacctaggaggtgtccgacacatgcctgttgcatacaggataacaagctgcggcccatgtactcttttttggttctctcttctgtgtagcacaatggagggagaatgcaaaaagcaggaccacacacctactaccctccgagcacagtgcacttggaatggattcacttcctgctcagcaaccccctgtgaggtccccgtgaggctcaggaccctgctgcagatcaggcggtgagtcactgccagagacgggatctggccctgtcgggggcatccttccacaactacacgcactgggcagcaagatttcaaccaagtcactgcttctctgacccttccctcattctctacgtcgtggaattgctgggagcgttaactgggatcatgtgtgtacagaacccactggcacacaagaggactgcaggttataggcgctgtcgctgtggtttccatcatcatcatgatgttgcaggtggcttcgcctacatgagtgagaacctgaccacatctgggaacagatctgtcgcgcagtttgtaggttttaggaaaggtctgttacctgcctcacgcggcgggcaagaatctgagcctgggtgcacccctgtgggacaccactctaaccctctctgctggttcagcatttcttcacctctgcaacctgctgcacaagggggagcgtggcaggggtacgggggtctcctgcagtaatcgagaggctctgtttagccaaaggcactccagatcaggcatggttctgttggattttctgctaatgttcatgacactccaccaaccacccgggcctttgagtcaccaagaatatcacctggtaaccctatgtgatttcagtaacatagtgacttctgacactctgtagcccatcttccctgttgccaaaatagatgaaatagaagccacccaggacagaataactcagcaagatgcctaagtagaaatacacatcagtgaagaggaaggtgctggaagggggatgtaggctttggttcccaagttgaccactgactggaaagaagtgcttgatgggcccctgtgtttagcatctcaaataatgcacctgaagtcagaaaggaggacagtgctggacctggactccagtgacagggcagcaggtcaccctgcacatagacttcttgggctgaaagccaggaaagaagatgctaatgggaccagcaacctctcacgctcactcatagttcctgggcacatggaccatttcaaagacagctcgccttcaaactcagttctcatctggggaaggattcaatctagtgacaagcagttattagattaataacttaaagatcaattaataacaagcagggacatgtcttgcagagcacaaagtctaaagggagagataaatgtaatttttttttttttttttgagacggagtctcactctgtcgcccaggctggaatgcagtggtgcaatctcatctcagctcactacaacctccgcctcccaggttcaagcgattcttctgcctcggcctcctgagtagctgggattataggcgtgcaccaccacacctggctaatttttgtatttttagtagagacagggttttgccatgttggtcaggctggtctcaaacttctgcctcgtgatctgcccacctcggcctcccaaagtgctaggattacaggcgtaagttactgtgcccggccagaaatgtaaatttttttaaaaagaggaagaaggaagctaagttgatgccaggagctcaggtggtggccaagtggcagagggcgtggggagctggagccatcgggcagccacagaaggtgatgtctgggctgttaggcaggagcaaaaggcctctctggaggaaggtggagcgtggacacaaggcagactgaggcggggagagtaggtagaaagctgtcccaatatcccagaggactgggtgtggaggggagacctgagggagaggccagtggggacaggacaggtttagggtgggcaggtgtgagtcctctgtaggctgaggggcaagagccaccacagggagaaggaataaatgcaggttcaaggggctggagagagcagatgtgcagggggaactggcctgcagcagaggggcgcacctcttcattcactcatgcgttcattcagtcacatctgtcgagtctccgttagttgccaaacaccatgctagatcctgagggccctgtggtttcaaagcctgtggtgtgtaggggcagcaggcaggcaaacaggccggtgcagtatcgagtgtcttggggaattctacagactgattattagcagcgcctccactctctttctcaaagtacgctagtttgggcaatcaacatagggccgccagagcactaggtgagcagggaagagggcgctcaacgggaaaggctccagggcagcacaagtcccagcagctccctggctagtgggagagggacacagatgcaagtctctcctatccaaggaagactctgggaagagctgaaagaggtgatcaaacactagttgttttcatacatgtgaagacacaaagggcggctcattcacacgggggatctgcttcaagcaggggcagggcgtgtacaggggagatgtggctaagggcaccctaggatgcaggagcacccctgcagccaggactccttcccaactccccaggcccagcgtacaagtactaggctgaatgagcacccatcacagtgttctggaaaacactcctgaggtcgtaagggtggcagggccaactcagagggtccagaggagaaaagcatttgcagtggaagctttgtggaacaaaatagaaagccatctaggaaagaagaggcaagtgatgactagcctggtctgtggtagagggcaaaggatccagtgaggagtggccaagcagcggcctggggcagcggggcgcacccagcagatggagcatggagctaaggccaccagtgagggagctttccagctggcaggccggggtactatagtgacgtatccttgaggttccagggccaggcagctgaaaaggaacatgagcagttcagactgccccatggctagtggagtgtggagacgatctagagatcatgaagaccctaggtgagagggatgagggagcaggaggatggagaggaaggcagatttctgtatcattggctgacagagcaatgctattaaacaatgccctgggtacacgctcctgatggactgcagttaaactctgagagtattcaagtcaaaagaaaaatctcaggcctggcgcagtggtgcacacccataatcccagcactttgggaggccgaggcgggcggatcacttgaggtcaggagtttgagaccagccaggccaacatggtgaaatcccgtctctactaaaaatacaaaaattagccaggcatggtgctgtacacctgtaatcccagctacttgggaggccagagcaggagaatcacttgagcctgggaggcaggggttgcagtgagccaagctcatgccactgcactccagcctgggtgacgagcaagactccgtctcaaaaaataaataaataaaaaagaaaaaagtctcagcagacagttatctgtccatggaggtacaggctgcctctatctgtcttcttcaccacccagaaccaaccatgccctggccacccatgtggagactgggggtgcggggcaggactgaatccaaaccacgacacagtggaggatgtggggagcccttcaggaacccgcagccagagctcagccactgaacacaaagagaggacacaggcttggcggactggcccctgtagtgcaccattctctaattttgttcaatctcagaaaatattacagtgaaaaagtgtggtggggaggggcaaactctcccccttcttcaaaggggcacctgttctgtgattcaagcacctgccctcctactgctggactaacagggtctatacactgtagccctgatgcatcttccacacgcctttctaccacctctacgtggaaacagggaaaagggctgccaccccaacccccatatctgcaggtaaagtagtttataagaagaagggccaagcactggagcacatagcattttatgtacctcatcagtacgagacagaagtgctaagactttttaactgtaacccagcaaacatcatcagagttggcgtatgggtggaacctcctggaacatgaatgcaaaggattgaaccctgacaggagagggcagaagacggtcagtatggtatgttaatatctaccattaacacattttcataccaccatctttacttggaaaaaaaggcaaactctctcattcatgaaaagaaaaacaaaaagatacctgaggtctcatccgtggattccatcgtacataataatttacccacaattccaaatgactcagactagcaacaggatataacacgtggttttcataattcacaaagaagggattagaaaactcgtctagctggctattgatatacgaccataaagatatcgtctttgtatatacatcctgaaaaacaaaaaagaacattggaaataaacttttcttcatatcatcaagaattagtattacaccgagaaaaggacttgaataatgaagtgaattcaaacgctgaaaaattcatgaatgtctactaggtcccagccccaccttcttcccactcatggcctcatggtgggatgaaatgaaaacacactgcttgctgtcctggaaaaacatattgctgaagttaggtagcatccgacaactgtgtctatggaaaggcagagtgagaactttctaacaaccacaggatgataggacccaccaataacaaatataattttgaattctggtgtaaggtttgcttttgtaggctgggcacagtagctcaagcctataaggccagcactttgggaggccacattgcgaggactgcttgaggcaggagtttgagactagcctgggcaacacagtgagactttgtctctacaaaaaaaataaatttaaagattagccaagtatagtcccagctcctcaggaggctgaggtggcagaattgcttgaggccaggagtttgaggctgtagtgagctatgattgtgccgctgtactccagcctgggcaatagagcaagaccctgcctctaaaagaaaatagagcttttgtgactcctttttttttttttttttttgagatggagtctcactctgtcacccaggctggagtgcagtggcatgatctcagctcactgcaatgtctgcctcccgggttcaagcaattttcctgcctcagcctcccgagtagctggggactacaggcgcacgccaccatgcccggctaatttttgtattttttggcggagatggggattcactgtgttgcccaggctggtttcgaactcttgacctcaagtgatcctcccacctcggcctcccagagtgctgggattacaggcatgagccacctcacctggctgtgactcttaatattgagaaatgagaatagattttacagttaaggttccttgtgctggaaaatcatagctatctggaggacaatgtgctgtggtgcaggctggagaagctctataaagacaagtaaatatatcactaagttatctcttcttcccctaattttgtagtacactattcagaaacactgtacctacttgcattgctcatctgaacaaaaacacccaaatgtgcaggcatggtgaggcaggtaaacgttaaacaatggatcaagcacaatgacaaagtcaaatgagaaaacggcaaggccaacagcattttctcccactctgctgctgacttcccatgagctatctaaatacaggaacattcaattaggaccatttcaatttgtatacatttatttatttataagagaaacaccaacaaaaattcaaaggatctggaatagctaaaataatcctgaaaaagaacaaagtaggaggactcatacttcccattttcaaaacttaccacaaagctacagtaatcaatgccagcagtgctggcgtaaggacagacatgcagatcaatggaacagaatagaaagcacagaaatgaactctctgacatttacggtcaactgatcttcaacaaggttggcaagaaaattgaatgagggaaagaaaatctttccaacaaatggtgctgggacagctagatagccaacacacaaaagaatgaagttggatccttaattcacaccgtatacaaacgttacctcagaacagatcacagacctaaatgtaagacctaaaagtataaagctcttagaagaaaacaggagcaaatcttcatgactttgggttaagcaatggtttcttagatatgataccaaaagtgtaagcagcaagagaaaaaatagataaattgcagttcatcaaaattaaaaacttttgtgcttcaaagaacaccatgaagaaagtaaaaaaaaacaacccctagagtgggagaaaatttttgcaaatcatgtatcttataagggacttgaatatataaagaatgtataaggaactcttacaactccataataaaaaggacaaacaccacaattttaaaatgaactaaggagctgaatacacattctccacagaagatatgcaaatggccaataagcacatggaaatatgctcaacatcattagtcgttggggaaatgcaaatctaaaaccacaacataccacttcccactcactaggatggctataatttttttaaaaaggaaaatagtaagcgttggtgaaatgtggagaaattggaagcctcagacattgctcgtgtgtgcaactgctttggaaaacaatctggcagttcctcaataggttaaacataattgccacatgacccggcaattccactcgtaggtataaatgaatgaaggcgtatgtccacataaaaacctgtacatgaatagttatagtagcattattcctaaaaaccaaaatgtggaaacaatccaaatttctatcaaccaatgaatggataaacaaaatgtggtctatccatataacggaatattgctcagccataaaaaggatgtattggtgcatagatgaaccttgaaaacattacgctaagcaaaggaagacagtcatataagttcacctattgtataattccatttctatgaaatgtccagaattggcaaatccgtagagacagaaagcagattgatggttgctaggggataggggtgggggaaatgggaagtgattgctaccaagtatgccatttcttttgggggtgacagaaattttataaacttaggccaggcacagtggcttacacctataatcccagcactttgggaggccgaggcgggaacatcacttgaggccaggagtttgagaccagcctgggcaacacagcaagaccccaatcgctacaaaaaatagaaataaagagattttatgaaattaaatattgatgatggctgcacaatatgtgaatatgctagaaccatgaaattgtacattttagatgggtgaattttatggtatgtaaattatgtgtcaagagagctcatttttttaagaatgaattttgcactccccctctcaaaaaaaaaaaaaaaaaaaaaaaacaagataaagccatggttaaaattctatatatgaacttcattcttctgcttctgattttatttgttttaaatagctttgagatataattcacgtaacacaaaactcactcttttaaaaatgtttttctttttattaggaggttagcaagtccccatcacactgggcccgcaggagtgtggattttactctaactgcagtgggaagcaggggagaggcacatgatcacatttcagttactgaatgctcgctgtggttgctatgtttagaatggactactgaaggtcagaaagagaatcagggaagcccattcctgggtttctgccttagtccagatgtgagacagtaggagtgtgagacagtaggggcttgagctaggcttatagctgtaaggcagttaagaactggcagattaagaatatactttgggccaataatcctagcactttgggaggctgagacgggcagatcacctgaggtcaggagtttgagaccagcctgcccaacatggcgaaaccctgtctctactaaacatacaaaaaattagccgggcgtggtggcgggtgcctataatcccagctactcgggaggctgcggcaggagaatcacttgaatgtggtaggcggagcttgcagtgagctgagatggcgccactgcactacatcctgggcaacaagaacaaaacgccgtcaaaaaaaaaaaaaaaaaaaaaaaaagaaagaaaaagaatatactttgggacaaggccagcagcattcaccaggggactggatgtggtagctagggtgagggtgagggaggagtggaaggtggctcccgtgtatttggcctcggcatctggatggccagtggtgctgtgtactgagatgcaaaagagcaggggaggagcaggaaaaggcatttaggtccctgaggcgagacaaagtcacttagaaagacggaacaagagttgaggggagaagaggacctgggactgggcccaggtgactccaactttagagactggttaaaatggcagccagtcagaggagactgagcaggggaggccgaggaggcaggaaagaggcaggaccaggtggggtcacagaatgagggcactgtcaactgtggggaggctgctgagagagggggaggcgggcgttactgacagactgctttctcctgaattctatactgtcctaacatacttggctcacaggcattggtccttgtctattaacaggatcatatactccttaagctgcctttttccaatgccttctcacttttgaccacgtttctcttttatcccacactgagggaaaaagaaagaaatgagatgtaactctgagaagtttggtaactgcttctttactactttgatgtaaaaaagtgttagcttgctacctaaagtgggctttttggctaatcagcagactccatttccaaggccttcaagtatgatctggccaacaccacagaggatgaaaagcagaatcccacggttttggagttggtgcagcggagactacatgaactcggagtcaggaggtccagggtctagcactcatctactcctgagagagccacgggctcgctgggtcccagccccccatgcctagaaaggaaggggcttgtgttagacacatgcggtggggctggccagaaccctgggagggcatttacagtcagcaatagcaccagagcgcagtcctccctcccctcagccctcctacagtagcacttccgaggagaggtgcctgagccacagggaaagcaacagacaaggatgcagcatactcacctctttgaatcgctgctgttcacagttgcacaaaaaggtcccaaaaagacagctataaaggtgatccaaaattgtaatcaagaatagctcattaaactcgaatgctgaaggaaacttaaatgaagagaaaaataaggtttagtcatagagtccaatttctaaaagtaatattacttttttatgaaagacagcgaaactacaacttggaatatagtcaaagatttaaaggaagactgagcccatgtaaagttcaactacctacagttttaggtccaaacttatagatctggctgagaaacaaccagcagcaactaaatttgttgtactcaatgcccagaaaagcttatgtagcttccacttctcaccatggcggcaggacagagcccagactcacccttctgtcagaaacatctagcaagctggatacaatataagaaatgactgttttcagacactggcaacaggcagtactggactgtgaccctgagagaagggaaacaaatgaggggagccctctattgtgccagcttccccgctgcagccacatcccaggtcgggggtaaggggagcagtacatccagtcataacatgtacccaaagtgactcaagaagaatagaaaatccgaatagctctgcatctattaaataaacaactcctagttaagaaccttcctacaaagacaactccatgaccatacacccctgaattttttttttttgagacggagtctctctctgtcccccaggctggagtgcaatagcaccatggcgccatctcggctcactgcaacctccaccaccagggttcaagtgattctcctgcctcagcctcctgagtagctgggattacaggtgcgcaccaccacgcccgactaatttttgtatttttagtagagacggggtttcaccatgttggccaggctggtctccaactcctgacctcgtgatccactcgcctcagcctcccaaagtgctgggattacagcacgcctgacttcttaccagtgtaaatgagcaagctgaacctggcaatacattttaaaaaggtaacacaacatgaccaagtggggtttactttacgaatgtaagcctggcttaacatatgaaaatctatgttacaaaacaaatcaattactgtaattcaccatattggcagagtgagggagcaaaaccacagatcgtcttgattgttttaggtaattcttgatgggattttgcagaattccagtgaagactattactattgccagcaggttctagccagtagctggtgtgttgtggccatgagatgatctggaagtgataataattaccctaacagcaggcatgtgctgagtgcctaccatgcgccagaactctaatgtaaaaacacagtaaaatattcatcacctactcaatgaagcaaagccaaatagtactacccagcatgcttgtatttaagttggtttacttaaaaacctattcttcaatcagagtgctgtgtgcacactatcatgacaaatcttcacatctccagaatgatcacatcaggatcactggtagagaagtttattttttagtttagctttactactagactagcaccaggcttttcaattagaacaatggtcaatccaggactgtccaaactccacctgaaactgttttcttcaccaggctattatattagctgacttaaggaattatgctcagataccgtggattaagatttgcttctctctccatcttaaggattgctctcagaaacacacaactctcctctaaggaatcccatcagaatattactgcttcagaaacctctggaaactaattctggtggttcttactggcacccttgttcttagatgaactaaatcaatgatgtgatgtctctggctgaaatgctaacaatatctactggttcatcctttcttggagcctttaagattgcccctcgcaactctgacagtggcctcacatttcaaacggctatctttctctatttctctctctctcattcatgcatttatttatttagatagggtcccactttgttgcccaggctggagtgcagtggtgcgactgtggttcactgcagcctcaacgtcccaggctcaagtgatccctcccacttcagcctgccaagtagctgggactactgccacaacccagctagtttttttttgttttttgttttttgttttttttttgtaaagacaaggtctccctatgttacctaggctggtcttgagctcctgatctcaagtgatcctcccatctcggcctcctaaagtgctgggattacaggcatgagctaccgtgcccggctcaaatagctatcttttaacaggccaggcacactatgtccaattttcccaggacttctctatgctgcttagttatgccctattcataaattattggcaccacagaatttgtgaattgtaagcaaatatatgacatttttgtgtactaaagctttattaaatcaaggataggaatgaaagatccagggttttgtcctatattttataattctcaaacttttaaaaacaaatgtttactaaaagatagcaaattattgacatattttcaagccatataagtgctatgaactgaatatctgtatccccccaaaatttctatgttgaaattctaatccccaaggtgtagtatgaggaagtggggcctttgggaagtgatcaggtcatgagggtagagctctagtgaatgggattagtgctcttctcaaagaagcccaagagagctctcttgttgcttccatgatgtcaggttacaatgaaaagacagctaatctatgaaccaggaagcaagccctcaccagacactgaatctgctggggccttgatgttggatttcccaacctccagaactgtgagaaagaatttctgttgtttataaaccacctcatttatgatattttgttacagcagcccaaacagactatgacaatgagtcttcattcctagcccctgagcctgcattgtagatttgggagcttggaaaggtgtgttctagagtcagtgacaacaagccttattctggtcactgggtaccagatatgggaggtcaaagtgggcagggctcagtccaagcccattggcacccatgaaaactggaaaacaaaggctccacctactcatgttgggtcaagactgccatttatactcagggggtgtcatggcattaagctcaactcaaaaaacagctcattggaggaaacagtagcaggtggagtaatataaacgaaagattaggtcgctgcaattcatagtttgttttggcctcttctcctggaaactgtaccttttacctaaaagtacgatttccgaaaatacatagcacagtaatctataataaaattctgcacctccttttttattgttttagagacagggtctcactctgtcacccaggctggagtgcactggtacaatcatagttcactgtaaccttgaactcctggactcaagcaatcctcctgcctcagccgcccgagtaactgggactacaggtgcacaccaccatgcctggctaattttttaattttttttttgaagagatggggtgtctcactatgttgcccaggctggtcttgaattcctggcctcaagcgatccttctacctcagcctcctgagtcgctgagattataggtgtgagccaccacacctggccccaattctgcacctcttgaggaacaaaaatatcaatgactattaaacctacccagaggagtaaggattgtattaaactatggatattattgagtgtctttgggactctaaagagtccctcaattatttttcccttagtttctttgttcacatacagactagttcattttattctgatatttctgacaattttacactgcatagcttacttaacagtaggcaacctaaaaataatctttcctatgactgcatcttatacctgctatatatctcattcatttcttaatgaactgataaagactagtcatggatgtctgtgctaatgcattaacaatgtaattttaaaagaaattaattatacacacatttcacagacagaatcttagagctgtgagaagcatctgaaatcttctaattcaaaccccttttcttaaaatccaataaaagcacaaaaatgacatggcttagacatgaaaacaggcactaagcagtataaagaatggaggtcagtttgaagatgtttaaaaatccacatttgggaggaataagctatttcacatccaccgaaatggtgctcatccctttagaagcactgcaattattttttgtgttcaacctttttatgcaatttttctaaaatgtgtttcatactttcttgtcctaacctgaacatgacaatcatttaactttcttattggctcagcatcaacacaaatagcaacagtgcctggctctataaaacagtaaggcttcaggccagtcttcatgcttctggagtgtgtttgctgctacctttcacatgcaccatcagcacacctacctctgggaccagcccctcttacccaggccagctctctaacaggctatctttaatcacctgtgacctggccatcagatcatgtgagaccccaatcagtttgttgaagctgggtgtaaaagtcagtgttaatttctaagtgagggcctgaggactccatgaaatctactttggctattcagactccctcccctttgttccttatttctagaggtatgtctctgtgctcccttgccactgaaaatgtgatctgtgacccgatggcatcacctgagagcttatcagaaatgtggcatctcaggctctgcctcagccccactgaatcagaatctgcatttcaataagagtcccaggggacttgtgtgctcattaaggtttgagcaatgttagtctacagcaatggtctccaagttgagcatccatcagcccccagaagggcttgtggaaccagagggctgggccccacacccagagcactggaaggtcatcagtgaggctgaagtttggtgtctctaacaagttctcaggaccacatttggagcactaagctagatcactggttgtcaaactcatttgcacatctgaatcacctggggaacttttacacacacctaagcctgtctccaggctcacaggaagaaggttcccaggggctggctgtgtgcactcaaggtggagagccatcttctgagttctccaggtcctcctcagggcagagctgctggggagccggacagcacaggcagcatcatgactatcaaccttccttctgccccaacacacactgccatcagtaacagtagctctcagtggggaaacaggcctagtatttcacagactttctgcagtagggaggcagatgtcctctgaaaaggccctgggctgatggtgataaggctgcgggaggatcaatcaagagcagcagggctattggtagcatccccgcagatcaccggcagtgtcctggctgcttcccttccccgtgactgaagcagccaaggccagagctcctggtgaatgactagcaagagaaggctcagaccctggatctcagccccctaacttgttctgtaccccatagccccaccctcagccaggttgcgcagcaggcactggggaaactactctcttttgcctctctctctggttccaggtccattgccctggcactgtctcttatcacaaggataggagaccaaactcaggtttagatgttggagatgagggggaaaacaacgacaacaaaacagtgcaggaactatggccttatggcctactttgaactgaagccaaagggcctgaccagctcaagggaaggggatccctagatggctcccttctttaccagggccctgtgcattggggtttgggaacgatgcaccagctaatagcaaaatgctatgcagcttcctctatgccattggttcttggacactcatttccctcagtgaccttgggtgggagaggctctggactggggcagagtgtggagattcctggattgcctggtctaatcccatgtactagcagttcattcccatcctcatttctaacatctggccaaatcttagatgaactgctcagcaggagactgtacttccttaaccttttgaaggggagcaaaagcagcagaatctatagaggagtagggccttggtttggacctagtggacaagatgattgataaaaaccatttgcaaagacaagtaacttttggtgtgaaattggttgtttctaatgttctgcttatatttctaagcgaattagaatcaaattgtgttaaataatggggtcatattttacacaaattcatcttgaatgaaacagcaataatagtttaatctttaagatatatttaaagcaaagactatatagaaatatacttgaaatctctcacctgccttgtcatttgccaaacacaatcaacaaactgcagaaatatgggagatcggtcagcatccgcatggttgtcattaccatggcccactcgctgaacagaaacagaaggttaaacgttttaacgtatgttatagtcctcttgaaagtcactgtaagttgtccagtggtaagaatcacatctcatcaggcctaatagaattcctggcacataacaggcactcaaaaatgtctatcaaatcgaaatgacttccattacttttagaaaacaaaatttcagtttacagtatttttacatgttgttttataatttctctttaatatagctgatatcaagaaagtacaagcaactagctagcaaacttttcagttaaaatggtagggtcaagaccagccaccacactaagtgtacagtgtcaacgtaggatgccaattagcagttcataaagcacattatgaatgccattttctctacaagtataaaaacattttttccatttttcagaaatgtcaggaagtctgagaatcaaaataatgattagcaatctacaacttttaaccaattcttcatgactcagagaaccccaacaactcaatcttgaaatggtaaaggtggggtccttgcttaaggcagtccagtattgtatttcatatcttttgatactttgtaagatatcaatagattcataccaaaaggtaaaagatagtattctcaaatacacaaataggattgccaaaacactgaaaatgccacaagtaaaaagatagctgaagggtgaggattctaagagaagcttcaaataatttgctatgagcaaaaggatgtggggaaaaaaactcattaagaaaatacaaagcaatcacttagaaagagcaaaaatactctatgaaattgccacctggaaagacatgaaaacaaataaatgacaaaatcaatattaacatctcagagtaacagtgtattaccttctttataaaaaaaattttaattgtggtgaaatacacatgacatataatttatcacttgaaccattatttttatttttattttttagagacagggcctcgctctgtcacccaggctggagtgcagtgacacgagcatagcctgctgcagcctctaactcctgggctcaagtgattctcccacctcaaactccagagtggctgggactataggtgtgagccatcatgctcagctaattctttattttgtagagatggggtctcactatactgcccaggctggtcttgaacccctgacctcaagagatcctcccacctcagcctcccaaagtgctgggaattacaagcatgaaccactacatccaatctcatcttaaccatttttaagtgtccagttcagtggcatcaagcacactcatgttattatgcaaccatcaccatttctagaacttgttaatctttccaaacagaaactctatacccattaatcactaactccccattccccacctcctagcccctggcaatgaccatttcactttttgtccctatgaatttgattattctagtttcttcatataagtggaaacataaatatttgtccttttgtggctagcttattttgctgagcatgatttctttctttctttctttttttttttttttttttttgagatggagtctcactctgtcgcccaggctggagtgcagtgacgcaatctcggctcactgcaagctctgcctcccaggttcacaccattctcctgcctcagcctcccgagtagctgggactacaggtgcccgccaccacgcctggctaatttttttgtatttttagtagagacggggtttcaccgtgttagccaagatggtctcgatctcctgacctcgtgatccgcccgcctcggcctcccaaagtgctgggattacaggcgtgagccaccgcgcctggcctgctgagcatgttttcaaggttcatccatgttatagcacatgccagaatttccctttttaagactaacattgcactgtatgttagtcttacagtgccacttaactgtgccacataacgacgtttcagtcaatgatgactgcatatccaatggtggtcccataaggctataataccatatttttactgtaccttttctacgtttagatacagaaatacttaccatggtattacagttgcctacggtattcagtatagtcacatgccacacaggtttgtagcctaggagtaataggctgtaccatatagcctagatgttagcaggttatccatctaggtttctgtaaggtacattctatgatgtccacacaattacaaaatcacctaatgatgcatttctcagaatgtatcctcatcatcacacaccacatgactgtatatatagaccacattttgtttttccattcgtctgctgatggacactggggttgcttccacctttgggctattgtgaataaagctactatggacaccaatgtacaaatatctgtttgggcccctgctttcccttctttggggtatatacccatcagcggaattgtcagatcatgtggtagttccacgtttaattttctgagtatccgccattctgttctccatagtagctccatgcattgccccactataaaatctcttgtaggacctgctgttcagtatttaaggcacctagggaactgttttacactgacagttcacaatttaggatcattctttcaacagatagccatggaactcctatggcgtgtgcaaggcatcatgcctggccctcggaatgtcagacattgtcatggtgtctggtagaggcccggtccttggctaggcccctaggagaccagagcaaatgagacactgtacttgtgcttgatgaataattcatttgtggtctagtcaagggacaaagatgtataaatcacaagggcaataaagtgttccaagggcttccaagtatgcagtgggtatggtgggagcacaagggaatgagtgaaccatcctaggatggggtaggggaaggaacagggagggacagtcatgtgagtcatagtcataaaggacatttcatttgagataaaccttgaaggacagggagatgcctgcttcccaggtagccaggaattgataaccagtggcaatgtggtggggaacactaaggaagccacaagtagctgggcacagctgaggcttagacggggcaagggaaagaagatgagaggtgaggctggagatgtagctagggccagatcaccaagggctttgagtgcacactgaggagtttgttcataaacctgtgtgctacaggaaggtgctgagggactcacactgtggagtggcagcatccaatctgttgtttggaatgctccatctggctccaatggggacgatggattagacagagctaggttgcagaaaggctactgctattgttgggatgtttgtcctcctaaacctcgtgttgaaatttgatccccaatgttggaggtggagcctaatgggaggtgttgggtcatgggggtggatccctcataaataaattaatccctccttggatgggggagtgtgtgagtgagttctctattagttcccgagacagctggttgttacaaagggcctggcaccctctcccctctctcttgcttcctctctcaccatgtgatctctacacactggctcccctttaccttccaccatgagtggaagcagcctgaggccctcaccagaagcagatgccggcaccatgcttcttgtacagcctgcagaatcgtgagccaaataaatttcttttctttctaaattacccagcctcaggtattccattgtaaaaacacaaacagactaggacagccacctaggagactgcctaagggggttgataaggcctgagttacaggagcatcaggggcaatggagatgagatcacagattcgctatccatatattcaaagttatgggactggctgagatcactaacaggttaaccacaaagagaagaaaaatgatccaaggactcatccctggaacaccccaacattaagaggttgggaagatgagggaagacctgaaagttggaggaaattcaaaaggtcaaagaaacctagaagccgaatgaagaaagtgtttggaagaaaggaagaatcaacagcatcgaatgctcaggccaaataaaacaagtgatgacggtgacacgaccagattgtgggggggcgggcattgtgagaaggaaccctggctgaagtgctttcaagacagtctggaaggagagaaatagtgatagtgagtacagacaacagttttgaggacattgttgtaaagaagagcagagaatcagggtgacagctgaggagggctgtggggtcaagagggtttttgttttaggatataacagaatgtctccacaccaatgggaatgatctagggaagaggggggaatggaggcaggataaagggaagaacaattggaaagttccatgatggaggcaagcaggcaagggcaggatcagcctcagctggaagccctgatggctcaatcacagaactccaggtaaagtagagtacacagatccagagggtgggtggttgcaggcttgaaatcactgtttaaaggctggctccaccctaactagctgtgtgactttaggcagataacacacactcttgaaacctcaatttccccatctgtgaatgagagtactatcaggattaaacaagatgctgcacattaacagtgccaaacacatagtggtggcttagtaaattgaggccattaggaatctgatagtcctattggcttcactgtggccatggtgcagtgagccccaggattagcaagtagggatgggagcagggcgctgtaggcacaccctgatgcatgtacctctgctcagtcccagtacatgctgccatcgctggcacctcgctagacagccttcaccactacccctctggcaaagcacccattcaagctttctctcccctaggacatacagtttggggaggaaggtagaaggcagtggcctctgagtcttctgaggtggcccaaacatctggaaagattccacacactctctcttccttaccgagaccagcctttgctgagggggtaagaaacaaaggaattggtgatgttgtttaaaacttccctggcacttagcatgggccaaacactgccctaaacatttgacacatataaactcatttctcccacacaatgcccccatttcagagaggagggaatcaaggcaagagaggggaaggcacatgcccagggatctgccagtagctcccaaagggcatgcagctcagagactgcggacttgtcccttctctctgggaggtcctcttgcaggcgctccaccccaggagtgcagggacagctggaagcttggcacactcacaccaaagccaatgaaatccttgcactacccatcttcctgctttccatagcaagtctaatggggacttcaggagtattcccattcaatgcacagttcagaaagatccctaacagctcaatggcctagacagaccagaagtagctgccagttggactaaaacacaaatggcagcccaagaatgccccatcagatgacctcacaatttcactcctaggtatataaccccctagattgtaagcaagttgttatagggtgacttgtgatccccaaaattgaggcctgaacattcggtagctcagcaatgtgtccatatttggagatggggcctttaaagaggtgatgaagttcaaatgagggcattgaagtcagccctaagccaatctcactggtatccttatgagatgaggacatttggccacccagagagacagcaggggtgtccagtagctcccaaagggaagaaagaccttgtgaagaggtagccagagggtggccatatgcaaggaaagaagggagacctcaagagaaatcaatcctgctgggaccctgattttggacttccagcctccagaattatgagaaaattaatttctgttgtttcaaccatgcagtctgtggtaccttgttatggcaaaaacttatatactaacattcacgcagtattcttcacaatagcaaaggtgggaacaatccaagcatccatcagcagatgagcagataaacaacatgtggtatatacacacaagggaatactattcagctataaaaaatcatgaaaatttgatatttgtcacaacatggatgaaccttgaaaatattatgcttagtgaagtaactcagtcatgggaggacaaatactgtaggattccacttatatgaagtacctagaaaaggcaaatgtatatgaagacagaaatattagtggttgtcaggggctgggggaagtgaggaatgactgtttaatgtgtacagcatttccttttgaggtgaagagtacggtttttgttttgttttgttttttgagacggagttttgctctgttgcccaggctggagtgcagtggcatgacctcggctcactgcaacctctgcctcccaggttcaagcaattatcctgcctcagcctactcagtagctgggactacaggcgcccgctaacacatctggctaatttttgtatttttagtagagacggggtttcaccatgttggccaggctggtctcgaactcctgacctcaggtgatctgcctgtctgggcctcccaaagagctgggattacaggcctgagccaccgcgcctggccagagtatgttttcaaactagaggtgatggttacataatactgtgaatttactaaaggacaccgaattgagcattttaaatggttaattctatgttatatgaattttacctcaattttttaaaaaggcataaatacactaaaataaaaacgccctatgaggaacatacaatgcctgaggtccatgtattttattatggcaattcaggtctgatatgatacagaagagaaagcctgcacgtgtgtgtgtatatatgcgcttacgtgtgtcacacatgacgtttacatccatatgataccgcaaaacagtccagcataaacctcactgtctgaacttaccagtgcaaacctgtgtccaaagcttatccactccttttctacgagagtttcaaatcctttaatggtcctgtagtaactgtccaacattagcatagccagagatgtgagctgggctgttcggtcccaaccgtcgctgcaatgcaccaccacagatgttttcccagattctattttatcagcaattcttactgccccagcaagcagcatcttcagaaaaaaaaggcacattagaccaggctacattgaatttcaattaaatgtaaaacaatgtaaaataattctggggagagctttggaagttctggtcaataaaccaagcaagaatggcaggcaatcagctgagaatcactaggaaatattagcatcacattaaaaaaataaaaagaaaagaaaaaatcttatactggagaaaaactacaggagtaaatatggttccttattaaagggccacgaagttctttaaaagcctgacctaaggcaagcatttttcccttttcactatgtcacaaaagccctccacaaagaccccagtctgatgctgtccatggaaactattgaataagaaagttcatgcacacagccaagaggcacttggagatatacgtatttatggcacaggcacaaagaagtcttaactggaaagcatataaagtgctggatctctttacccttatatattccagccaatgcgtcccatccacattggagagccaccgcgcctcatcgatcgaagggtacacaatctcttttaatttgcgtagtgactctcgcatgacatgaatgttgtggatctccaagaacacaagttctgcatttgggtaagcactttcactttcatatcctccaccctttgtctacgaaaaacaaaacaaatacatcacattatctggaattaacttttctattctttctagtgctatgagatacagaccactaaagaagcaacaaactcatctgcaaataaacctcctatatccttgtatgagtttcctagggctgctggaaaaagaaccacaaactcagtggcttaaaacaacagaagtttattctctcctagttctggaggctggaagtctgaattcaaggtatcggcagtgccatgcttcctccgaacactctaggggaggatccttccttggctgccccaggttccgatagtcccaggtgttcttggcttatacacacatcattctgatctctgcctccatttccacctgaccttctttcctttgtctgtgtctgtctcttctcctcttcttctaaggacacagtcatttggcttaacccccaccccccaattcaatatgaccacatcctaacttaattacatttacaaagaccctattgtgaaataaggccacatttataggtacttggagttaggactgcaacatatctctgagctaacagtgggatgtgcttaaggaactgaaaagaacctcacatagctgagacatggacctggaagatgtggcgagacaggaaggaaaggacccgtgggtggagggctttggagaccctgttcaggaacctggatatcactgccttgcggctctgagggatgtgcacagagttgtccactgagaagatcactctgtacaacatggtgactacagtcaataacaatgtagtctgtatctgaaaactgctgagagtagattttaagtgttctcaccacaaaaaatggtgtgttaattagcttgatttagccattccacaatgtgtacacaatcaaaataccacgttgtacaccataaatatatacaattcatttatcaattgaaatagtaacaataagttttttttaaaaaagaagatcactctggtcataatgtggagatgagattgcagggtgtgaggcagaagtccaatttcaaggttcctgctgtaggtgaggtaagagatgatgggtcatccaaaaactagaagaggagggcatacttcctagttcattccatgaggctagctgtatcctgataccaaagctagacaaagacatcacaagaagagaaaaccacagattaacatcccttatgaaaatacatgcaaatatcctcaacaaaatactagcaaacccaatccaagagtatatgaaggggactgatcacataccatgaacgggtgggatttatcccaggaatgtaaggaggttttattagcttcctaagggtgctatcacaaactgggggacttaaaacaacataaaatttattctctcacagttctggaggctgaaagtccgagatcagggtgctggcagagttggttcctttaggagggtatagggaagaatctgttccatgtctctctcttagcttctggtggttgctggaagtccttggcactcctcagcttctagctgcatcatttaaatctctgcctctattgccacatcgccatcttccttctgtgtgtgcctgtgtctctacatggctttcttatacggacactaggcactggatttagggccaaccctactccaagatggcttcatcataattaatacatctgcaaagatcctatttctaaataaggtcacattctgaggttccagttggacaaacttttgggagacatttttcaatccacgacagtggttcaacatataaaaatcaaccaatgcaataccaatgcaagaagaagatatgaaaggcagccagattgtaaaggaagaagtcacattatctcgacttgcatatgacataatcttatatataaagaaccagtggagacctagaaaatactgtttcctagacacatatactgccatagttaaaattattctagatatacaatttagtgtcctgtctctatctctcctgcatgggataaaacacaatgaactgccctcaccctgttggctagtctgaagatggcctccaccaatatggcttttctcacattttgtaattccttgggatatggtggtgacaggtgggaggcagagatgtagaaagactgacacagctaatgatccagatgtggggagcaagggggcctcactgagggatgcctccctatggtaggctgaaaagtggccccgccaaagacatccacatcgaatccctggcaatggtgaatgtgaccttatttgaagagaaggtctttgcagatgtttaaggatcctgagatttgcagatgtgtttaaggattccaagattaattgaaaagagggtctttgcagatgtgtttaaggatccaggattatttcaggtggaacctaaatgtcatcacaagtgtcattagaagagaaaggaggagacgcagaaacccagagcaagagagggtcatgtgatgacggaagaagagattggagtgatgtggctgcaagcccaggaaggctggggcagccaccccatgctggaagaggcaaggaacagattctccccttgaacctttagagggagcagaattggcctccagaattgtgatcaatacatttctggtgctgtaagccaacaaattggtagtaatttgtatgacagcctcagaaaactaatacttccccatcttcctccctgccctgttcctctcccagtcttccccatctcagtaacagacaccactattcaccctcaagtcagacacctgggcaacacccttgaccacaggggtggcgagcttatcagcatcatgtactgtgccctgaggatgcactcaccactgtgctaagtcatttacatgcattcttctcactgaattttaatcctcacacaacccatgacatgagacactgatattatctcctgttttacagaagaggaacctgaggcacagagagaggttaagtaaccggctcaggattctagagcaccaagtggcagaacctggaggaaaacccaggtgtaactgattccaaagccaaggggtctcaccaacttgccatcgtgcctctcaggccagttggaatatacggagggtttgtggtctgggaaacagccaagcagagatgtcaaccatacaatgggatagaaatccagtctcaaccttaggagggatcaggacaggagagaaactgcagtgtcaagctcaagttgaactcagcatacagacagtgtttaaagccgtgtcatcagagatggccccaggagtctgtgtagagcaaagaggaccccagaccaagttcgaggagcaatgccatttgaagactgggaagagaaatcagtgaaggagatggagaaggccaggctgaagagcgagagaaactcagggtgtgatatcatgaaagtcatgggaacggaggtgtttttaaccatgtctcactgccacccgaggtacactacacaggtgctccatgagatttatggaaactttgtacatttacacatttcacatggctgattccattctaaaagaaattcagaccagacatgaattaatcaactaaccactatattccttaaacggacttccaaggacctcacgatcatttcattaaaatgctaaatcctttagatgataattgtctttctaggtctttacttaattgatttagcagacaggatattgtagagaagcaatgaaacagacaagatcccaacccatgtgagacaccaaacacagcccaaggagcatacaccagggaggaatagctatgggactccaaatgattctaacttcaggtggtgaggaaatcaatgagttattccaactgcataatgatttacagacaggacatgaaaatatccagtgtttctgcagtgctattaagaatataccttgttggtatcagcgacactgttttgtcgagcatcaaagatgataagcttgtgtgactgtgcgttagcatccattattgtttgcaagtatttttcatcctctttgcagcgcttatcattgggacccacaagtggctggctgcaacgggtaatcgttgcttgactttccggatgaatccatgacaacacctagtgtttttaagcaataaatattagtacagttcctaaagaatgtatgctctaattacctggtaggaaaaacaagttcccttctcaagcacggtctcttatacatattttcttcaaaagtgagagtgggcaggccaatcacagcattgtagtggccatcagactcaatgttttggtcaggatgaaacaattctgactacatgagctctaaaaatccccttccatccccaatattctatgattctaagaaaaacaaatcctaaatcaaactattactaaaatctagccccattccaatttgattgactaattttaccttgtctcctaattttaaaaacatctttgtatctcaacaataatatacgtggcagggtaaggacaaagtgaatatacagtctcttataaaatctgacactctgccaccccacctctcattttcctccagtggccaagtgactcaggattacaacagatgcaaactctgggctcaaaccattactcccagctgtctgctactacttctgtaatgatgtccctcccacgcagctatggcatcatgctcagtatctaagaaagaagcattttctctaggatgattcagtgaaaccagcaatgccaactggtaatacaatagcatgataacttgttgttgctactcctttgtcattctctactactttttgagggtatgactgaagttccccttatacttagttataggaaatcgtaaaagagggagtcatagcaaacagattgtttatataattaggtatttgttgagaatcaaaggtatgttcaggtttataagcttatttttctgctttccatttttgttcactagtttcttttttgtcttaaatctctccatattagatctaacgcaatatatattcctatataaatgacaatgtttattacttacagggactctgccttttgctcgaaaagctgccacttttgaaaggtcatcatcttttacactagttggcacaacaatgatggcagggtaggtgtcacagaactcataattactgtttattttggatattttccaactctcatttggcaagccctgtaaggtgttggagaaagaagaagagggtgaaatgcatgactttacactttgaaaaagtactaagcatgaagtacatccatttcttatttgcaactaaaatccgtttataatttattgtttattgtaacttaaaagtcaatatatatatttattcggtaaaacccatttcctagacatttctaaaaatctaaagaagcataagaatatccaaaccatactaaaacatgaaaattatacgctagaatcacatttctatatatttcttgtcctattttctataaataatgagctctgttatttttgagaatatactcaaaagtcctttagaaacacagatacctcttacgaatgtctaaaataagtaacgtaaaacattataccaaatataaggtagagacaacgtcatgaaacaaacgtcatgaaaataagatcttagtggaataatttgaagctgacaatgcactgaagagttcccagacccgggaacactggatcagacagatgtagtcacaccacatgcttcgaatctaactgtagtcagtggtttggatccttactcatcaattctttaccagaacatctaataaaaaccatctggcaaatttggtttttaaacccgtccttgtccttgagtcccactcaccctctggaaacaggatgaacaaacatgacaaagtctaaggtttggcacagggagaagagagaatcaaggaaagatggagaacctataagctagcagttaaacctgtgcataacttgttcgaaaaagtttcttctccaccacatcatttctaaccttttagaagagaaaaagatgctcaacctattattttcagtttgataagcaatatactttacctgtctcttatattcagatactggatcataaactttccagccattaattggaaatttttctttatagctgaatgcaaatagtgcctggacacaaaaaccacaaaacacatatgttactatttctttttatatcatatacccaatattaaagcttttcattctaatatgagctgagtgtattaagattcctattttagtctgtaaattttacagcaacaaagtagcagcttttcttaagcattacccagaactgacaaatttcaaatattctaatattagtcaccaacagaggaaaaaagagaggaaaaaaaaaaacctctggaaaaaggaataattaaacataggatatttggacccccacaaatgcatgcagaaaaggtttactctggtgtatttacctgtccgttagaaagaggaaatgcatgtttgttgaggttttcaaatatccctagtttactctgttcttcctgtttataagcaagccgcaagttcctcatatcctgttaaacaattagcaaaactcggttattcaacatacatcaggcacctataagccagataccgtgccataaataaggaaattatttttttttaattcatttctccttttatactttatcctgctccaacggcacagtctccactcattgcaacctccgcctccctggttcaagcaattctcctgcctcagcctcccgagtagctgggattacaggcacccaccaccactaccggctaatttttgcatttttagtagagacaaggtttcactatgttggtcaggctggtctcaaactcctgacctcacgtaatccaactgcctcggccttccaaagtgctgggattacaggcatgagccactgcgcctggccccacttatgttttcaaagaaggactatacatacattctcatgtgcataggctatctgtggagggttacattagaaatcggccacagtgggtgcctgaaatgagtggaacagggtggcagggtggtgggtggaaggagactgattttttactatacacagcttttgtatcttttgaattgtatatcacctgttaaaaaataaaccccacaccttgtaaagctcttaggcatgatctgagaaggctgggagcattaccttagtaatctaggttagagaacatttaaagcagttgttagcaaatgctcaccccagccataaaaatatcttagtaaaagagccccaggatgcctgcctaagcaacataatttcctgacatgccctccctctaagctacatggctacacacatacaccttggtggctgactgagctgacttgctatttaagattgcttacaagctaaggaaagagcacatgcaaagattctgggatgtgtgtgtgtgtgtgtgtgtgtgtgtgggtgggtgtgtcaagtatgaaccaccaaaggaaagcccatgtgactgggatggccagaatgagaggagggcagttcgagaccaagctgcagaggaaagtgggtcaggcagagcagtcttgtaaggagagtttttcttttagtctaaggataatgggaagatactcaagcgtcatgagaaaggggacgacatgtttcaaaattgcagaaccgatcaagtcacccctctgcttgccattgttccatatggggaaccctgcctgagaaggacagttgtcagggagtgactaaagtgagtttagtaagccaacagattcatgatctggaagagtaaagggttctttggaaaaaaaaaaaatggttttgaacgcagtctaggaccaaccagagggagctatcttcagagattgaatcaaaataaatagattgtaaggaatcctaacccaaaatttggaaggggcgctgatgatcctgcaggcaggatctcttttctggtacttcaggtagggtttttggtaaacattaccaaagtcaagtcactgggaataaaatacatcaattaggagtgggtcctacatgacttcgtgattaaagttatcacacacatttctacttaaattattagaagaagggtacaaaataaacaaataagcccagctcaacataaaaattccaagatagccaagaaacttaatctcatttttaatcacagaatttatgggccactgctgtccctttaggaagtctctgaccatccacattgttctgaacgtagtcttaaaacaacaaactggggaaatgtattggtctctgcttttcacttgacttctctgagatgtgacaaacaatcacttaggttataggtccacgttaattagaaatacagtcagcccttcctatccatgggttccacattggaggattcgaacaactgcagatggaaaatattttttaaaaggatggttgcatttgtgctgaacatgcacagacattttttcttgtcattattccctaaacaatacagtataacaactatttacatagtgtttacactgtattagttattataagcaatatacagatgatttaaagtatatgggagaatgttcttaggttatatgcaaatactacatcatttgacataaaggacttggacatccatggatttgggtatctgaggcagaggtcctggaatcaatcccccaccgataccaagggacaattggacttcgatggaaaaggtttacttcaaagggttacataatagtttaaattcgatatgagatttgaagaggttgctatcccgaaaacatttgagttactagcagtacaaattattctactgtccaaagaccatgaagagactgagggagaaaaagttcagagctgattgccctcttttagttttcacttggcgtttctattataccttgcacactatctctataccacaggaattgtctccatggctctgtgctccaatcttctccactctgctgatcactccaaggggaacatcaaggataaaatgcgggtcctaggttcaaaaattaagatcaatgcctattagtgtcagtcaacagttttcatattttaagtctttgctgggttacaaaacatgtttgtttacttcgcatttcctctttgtcccagctaaattgaagtctgattgacagcattccttgtgaaatatatattgagacaacaatggaatttcccctccaggtttaagcggtactttaacagcctttgttttcaagatacaaacatctgtttgcaaatgtgtgcatctcaaaatccaacctgtggttatctcagggtaatgggatttcaggggactttttactttcttcttttagtgttcttttaaaagtgtttcttttaaaataaaacacactttaaaaaactcaccctctcgacatttttgaagtacagcttaaagtccgtcactgtcagggttccactcactgctcccataaatgggcagatatacatgacatctttcactgaaagaaaaaggccaaagtagcaactactgccatagacttgtgcttccataaaacttaacacgagttttccaaatatatatttgtgattccagttttccaggaattttgtattttataggattatatcaattatgactttcaatatagagagatgcatagtcttctaataaatttcaattttttaaaacaaaattctgatttgctacttaatgaggttttaagtaaagggcctcataagaagttatattctgtcatttttcctaggtagttaacattttccctgggtgataaattaatcatattcaaaacattaattaaactctgaaaaccctgggctactgtttcatgaattactgctacttaaaactaatgaaaactaaagattgtctcctaatgcatctccaaaggaaactctttttacagaagacaaaacctagaaccacatcaatgaaatggaaaaagacttatttcaaattccttatccccttatcagttttaattttttgtcaatatctattaagtgcgtgacatatttaattcccattagtgttaagaagctcacttctatcacaaagataccacatcttcatgttttcccaaagtgccattccactggaatgacaagaatatacatagctatatatgagtccaagtgagacaacaaaaggcattaacgtcattgaaccaaattctcagaatacttccattgaacttttctatactccttatgtactgagagccttctattgctgggattctgggtataattggaagaagttcctgtccatgagcagcccatgacctgtgagagataccacacagaaaaatcgccattatactagagcagaggtccccaaccttttcggcaccagggactggtttcatggaagacaactgttccatggaccagggcagaggtagggggatggtttcaggatgaaactgtttcacctcagattatcaggcattagaccctcataaggaacatacaacctagattcctcacatgcgcaattcacaacagggttcacgctcctgtgagaatctaatgccaccgctgatccgacaggagacggagctcaggcgataatgctcactagcccgctgctcacctcctgctgtgcagccccgttcctaacaggccatggaccagtgctgatccacggcccatgggttggggatccctgcactagaggttgacaaaagctaaaataacaatgtggacacaaagtattacaatggaagttcagaaaaggatcaacttaactcaataggaaagtgggtagggggagtaagagaaggaagggaggaagggcacagtgataagttgttagaggttagtatgcctggatcaatgggtgcagtgaggacagtcgaatatgaggccagagaagttggcagggagtggattggcaagtgcttctgtaggagactaaggcattattatcattatccttaaaagataactgtttaaacaaaaacaaaaacaatatattgtggggtttataacatatgtaaaagtaaaatggatgacaacaacagcataaagggtaggaggggacaaatgggagtatactactataaggttcttatcctgtacatgaagcagcatacaatcatttgaaggtagacataaagatgtaaaataactagttacataacaaaacaaacaattatagctaatatgcaatcacaggacataaaatagaattctaaaaagtaaaaaccccatagtctcgacccaaaagctccttcagctgataaacaactttgataaagtttcaggatacaaaatcagcatacaaaaatcactagcattcctatacactaacaacagccaggccaacagccaaatcaggaatgcaatcccattcacaatagccacaaaaagaataaaatacctaggaatatggctacccagggaggtgaaagatctgtacaatgagaattacaaaatactgctcgaagaaattagagatgacataaacaaatggaaacacattccatgctcatggataggaacaatcaatatcgtgaaaatggccatactgcccaaagcaatttatagattcaatgccattcctatcaaactaccaatgacattcccagaactagaaaaaaactatttaaaaattcatatggaaccaaaaagaatagccaaggcaatcctaagcaaaaagaacaaagctggaggcatcatgttaccagacttcaaactatactacaggcccacagtaaccaaaacagcatggtactggtacaaaaacagacacacatagacaagtggaacagaatagagcgcccagaaataagggtgcacacctacaaccctctgatcttcaacaaaagcaagcaatagggaaagaattccttattcaacaaatggtgctgggataattagctagctatatgcagatgactgaaactggatcccttccttacaccatatacaaaaatcaattcaagatggattagagacctaaatgtataacccaaatctgtaaaaaccctggaagacaacctaggcagtaccattctggacataggaactggcaaagatttcatgataaagatgccaaaagcaatcacaataaaagcaaaagttgacaaatggaatctaatgaaactaaagagcttccgcacagcaaaagaaactatcaacaaagtaaacagcctacagaatgggagaaaatatttgcaaactatgcatctgacaaaggtctaatatccagcatctataaggaatttaacaaatttacaagaaaaaacacaaacaaccccattaaaaagtgggcaaaggacaagaatagatacttttcaaaagaagacatacatgcagccaataagcatatgaaaaaaaagctcagtatcactgaacattagagaaatgaaaatcaaaaccacaatgagataccatctcacaccaatcagaatggctattatcatattaaaaagtaaaaaaaaaaaataagagatgatgaggttgcagagaaaagggaatgcttacacactgttggtaggagtgtaaattagttcaaccgttgtggaaagcagtgtggtgattcctcaaggagctaaaaatagaactaccatttgacccagcaatcccattactaggtatatgcccaaaggaatataaattattctaccataaagacacactcacgtgtatgtctgctgcagcactattcacaatagcaaagtcatggaatcaatctaaatgcccatcaatgccagattggataaataaaatatggtatatatacaccacggaattttgcagccataaaaaaggacgagatcatgtcctctgcaggaacatggatagagctggaggccatcatccttagcaaactaacacaggaacagaaaaccaaatactgtaggttctcacttataagtgggagctaaatgatgagaacacagacacagacgcaaagaagggaacaacagacattggggcctacttgaaggtgaaggttgggaggagggagaggatcagaaaaaatatctactaggttctaggcctagtatctgggtaataaaataatctgtacaacaaattaccatgacacaagtttacctatatgcacatgtacctaaaatagggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtacatacccaaaggactataaatcatgctgctataaagacacatgcacacgttatgtttattgcggcactattcacaatagcaaagatttggaaccaacccaaatgtccaacaatgatagactggatcaagaaaatgtggcacatatacaccatggaatactatgcagccataaaaaaaggatgagttcatgtcctttgtagggacatggatgaaattggaaatcatcattctcagtaaactatcacaaggacaaaaaaccaaacaccgtatgttctcactcatagatgggaattgaacaatgagaacacatggacacaggaaggggaacatcacactctggggactgttgtggggtggggggaagggggagggatagcattaggagatatacctaatgctaaatgacgagttaatgggtgcagcacaccagcatggcacatgtatacatatgtaactaacctgcacattgtgcacatgtaccctaaaacttaaagtataataataataataaaataaaaaaagtttaaaacaaaagtactcaattcaaccataaaaagagggaaaaaagaacaaagaataaatgagactaataaaaaccaattatcaagatagtggatttaaacctaattatattactgattatataaaatgtaaatgatctaaacaccccaattagaaggcagagattgtcagtttggagacaaaagaaagaaccaactatatgtggcctaaaagaaactcaccttaaatataaagacacaaatagtttgaaattcaaaggatgaaaataggtatatcatgttagtaaaattttttaaaagctataatgtctataataatatcagacaaagtagatttcagagcaaagaatattaccaagaataaagaaggtcatttcatgataataacgaggtcaattcgtcaggaggatgtaagaatcctaaacatgtatgtatctaataacagcttcaaaatacataaagcaaaactaatagaactgcaaggagaaactgacacatccaccattatggtcagagatttcaaaacctctctctctacaattggtagaaatagacagaaaatggctaagaatacagatcgacaaaatctaattgacatttatagaacagtctactcaacaacagcagaaaacacattcttttcaactgcatgtagaacatttaccaagacagggcatattctgggacataatatgagccttgatgaacataaaaatattcaagttataaaaagcatgttttcttaacacaaaggaatgaaggtagaactcaataatcgaagaaaatttgggaaattcacaaatatatggaaattaaacgacacactcctaaataactcaagggtcaaagaagaaatcaaaaggggaattcaaaagcattttgatctgaatgcaaataaaaacacaaggtcataattgatgaaatgctgctaaagtagcagtgggaggaaaatctaaatgcctatactagaaaataacaaaaatctcaaataaatgaccacagtttccacctcaaaagctacaaaaagagtgaattaaacccaaagtaagcagaagaaaggaaataataaagatcagagtggaaatcaatgaaacagaaaacaaagaaaataataaaaccaaaagctgactcttggagaagatcaataaaatcaataaacctctagccagatgagaaaaacaaaaaagagaagacatgcacattaataatatcagaaatgagaaagatgtcactgcaaattctacagatattaaagagtaaggaaatatgacaaatgactttatgacaatcatttgacaacttggattaaatggacaaaatcctggaaagacataaactaccaaagcttacccaaaagaaaaccacagtctaaacagtcatataactactaaataaattaaatttgtagttaaaaaccttcgcacaaaagaaacgcaaagtccaagcagcttcactggtaaactctaccagatatttaagtaagaaataagctatcccggaaaactaaggaagagaataattctcaattcattctatgaagccagctttactctgataccaaaacctgacaaagcaattacaagaaaattacagaccaatatctttcataaatgaatattgacgtaaaacttctaaacaaacttttaataaaccaaatccaaaaatttataaaatggatactacataataagcaagctgagtttatcctgggaatgcaaggttgatttaacaatcaaaaattaattgacgtaacccaggatactataggttaaagaagaaaaatcatggttacatcaatcaatgcagaaagagcatttgagaaaatctaacatcaattcctgatgaaaactcacagcaaactaggaatagaaaggaactccctcaacatgataaagggcacctatagtaaaaacctgcagctaacattatatttcatggtgaaagactgaaagctttcccaagatcagaaagaagacaagaatgtccactctcacttcttctctttaacattatactggaggttcaatcaagagtaatagggtaagaaaaagaaataaaaggcattcaaattggaagggaaaaactggaatgctcatatacggctactagaaatgtatactggtacgaccacttagaaaacacattagcagttttttaaagaaactgtatagctatcatatgatctagccacttatctattaggtatttactcaggagaaaagaaaaggtatgctcatacagacttgtacattagtgttcacagcagctttatttgtaacagccgaacagtagaaacaacccaaatatccaccaacagatgaatggataagcaaactgtcatgtagccatataatggaattctatccagcaataaaaaagaatgactgttaactcatgccacaatatggatatcaaaataattatttgatttgaagaagctagacaaaaaaagaacatactctatgattatatttccataaaacataagctagcctatagtgcttggggatggcggagaaggcagaggaagtagggattataaaggggaataaggaaacgaaaactgggaggtgatggatatgtttgttaccttgactgtgaatgatggtttctcaggtgtacaccgtgtcaaaactcttcacattctgacaatgacaaactgaagtaatactttagacggagtattttacttcacaatgacctatttaaatagtttgcctccaggaatatattttattaaaaagtagagggtcaatttacttaccctttgcaagccaccagaggagcataaagcatatttacatcacttaaggatttgcagatgtccttaagatctaactctaagatatttccaataattcgtattggagtggggccaggcaggagtttctctctctctgagctctgtttccagagtgaaaggaaaagaaaatgggagagaaagagcaccaggaccgcagctaaatccactgaagccttctcttcttactacaacaactgtgagcttgcaatccaagcttttataacgctccctgctcattcaaaatatgtatctgatgtgcaaagttgtcaatcacctacatgagctctaatcttttctgagctcactttgactcactgacaaattataaaactaaagtgaaaaacaacctcttcacattttacattttacgcctgtgttgtttactgtctgaagaagaagcaggggcatgacataattacctctgcattttaaacagatcattaagaaaacagtatgagggcagagctagaagaacgcccagagaaggaacaaagagtccagaggactgccaggatagaatgaagtcctagaacccaaggaaataaagaatttcaaaaccaaggacaagataagcatggtccacagacacagactaggatattcagcagcaataattgattggaggatctggtgggagagccccgctactcaaatattcttggcacaagatgactatactctgagactgagtgcgcctctttgggagaaagccatgatggaagaaggaaacagtctagaaaaccagactgtccaacccaaccaagtgatgagatgaacggatcgcatccagctgcccctcccatccacccatggcacaatcaactactccctgaaaggcctggcagtacaccatggagggatatgggaggcctcatgccatcacctttaaaagccaggatggcaacacaagcccttgccatgcaccaaaattgtactttttgggatctgataaaccactaaaatttctttgctgagttctcaaaactgttattaaaacatgatataggtctcctatattttccttatactgaaggattccaacaaagcagtgaactgacattacactgagtgtctaatcagctttcagttcaccaggaaaagtcaggcccctcttctgttgggaacgccatcaaatactcaattggaacttaacgggatcctctgcagtcttctatctcttaggtcatgatgacactaatgaggatgaatagatctagtccatttgtcccctaattaagttggtctggcggatctccagcacatacatcacctccacttgcaaattaagtgccatttcattttatggatctcaaaaagcgaagtgtacacactaaacttaccaatggctttaattgattctcctgggaaaagtggagcctcttccatctgtgccagcttatttccatcccttagagcctggcaaaaaaaaaaaaaaaaaaaaaaaaaaaaaaaaaaaggacaccaaacgggagtaaatctcactttccgtatacctgtgaagaatttcggtgttctgtgatgtcactataaggctacagaagcgtgcaaaataagcacccaaccccttcaaagacaacttaaaagcttagcatcacaagacaccatgctgcatattctagcaaattgttacaacatatttaaatttcacagttaggaagcattaatacagaaatggcttgacatgacagaaagatactgtaatcactacacagatagctattaaaaggtgtctctagaatttgcaaataaggccagaaaaaggttaccttctgagcatgaaactaatacaaatgaaaccaacatgagctataggtgcttagctaactggagaaatgacccagcctaagagaaagtttgggaaggccagaagtctaatgaaaataaccggagaacagtctcggtacagtacacaactaaggaaaggcctaggctttgctactgcagcccagctatgtgtgtgtgtgtgtgtctgtgtgtgctcgtgcacacggacatgcatgcacaaagcgtatgaccagggacatgaagagtgaagttgtcagtgttcacccaatccaggccatgagagagtgtgctctcatctggcaggcaacagtattccaatccctgctgcggagcagggtgttttcgtcaggcatgtctcaagacaatttactttgcagtaatttcatactcaccaagcaaattgctaatgatttactaggtttcctggctacaatgatgctaggaaaaggataccttagatggccagaaaaatacacgcccacgtttttaaattagcagattggcactgcagcccagtagccactcccttgtgagcttggttggatagtgccagataattgaggggaggtgagaaaatggtgttcttgaactacaaagctagggaccaaagcctgaactcggggtctattccaaggtaccgccaccctgtgagacgctgccaaggaaaccagtcactttctccttggcatctctgacataatgtgtcatgaataagaataaggtgatcagaacccccagcaattccaaagctgtatttcatagagcattactttcccaagagatgtgaataggtcttaaaaaataaataaataaataaaagtttgggaaatgctgggttaagcaaaacaagttcagctgctttttttcttctcctttttttttttttttttttttttttgagatggagtctcgctctgtcgccaggctagagtgcagtggcacaatctcagctctctgcaacctctgcctcccgggttcaagcaattctcctgcctcagcctcccgagtagctgggactacaggcgcacaccaccacgcccggctaatttttgtacttttagtagagacaggggtttcacattgttggccaggatggtctccatctcttgacctggtgatccgcccacctcagcctcccaaagtgctgggattacaggcgtgagccaccgcgcccggcctcatttgctttttttagtgagacatctttagtgtgtcaatgcacaccgaatccgcaagagggcgccacagtataatgcattcctcatacctatttgatcgggactgctttttccacctgttaacatcggaggccactagtgttcagtggaaaataggtcgaataatactacgctttcagcataattttgtaaagcaaaatatttttaaatggatgtcttttataattctaaattattgaaaattcaaaatagtaattattttcatagttacaagaatatttcactatgttttattaaaggacctaaaggtcaatttagaaatactacacatagtagtttcatcacattttatacagggaagaaagccaaactataaataacaaattcaatgttaaatgttggtcagggctatgttagttctactgggagaccacaaaatgacatggtccatcctcctccttatccaaagatgcatggttaaaataatatagattaggaatcatcgttacctccaaacagttaattcaattcaaatttttagcccagactggtttttaaagacattttctgccaaaattttttggaagtaaacacattaagggtaggtgtggagaacgattaatggattcatttttatactcacatctgttttggaaatatattttatgcaataaagcataaactaacaggtatacttataaatgtctggttttagaaacactaaaagatctccaatcttagaagccttaatttgaaattctgctttatcgcctgaactagtgactaactgtatagcatctcatgaagtgagaaagctattttaatcaatatcagagttttaaattacttcaaatgttacgttgttaaagcctattttaatggctaaatattatcatgtattatacagacttaagtttcttatatgttaaaaataagtgaaaatagattattttgaaatataattactaaagcaagctgctttaatcaactgaatctggaggagcttaggaaaggtatgactctctctatttagagcaagccacatcaaacattttaaagtcctcaatccaggactagctaataaaatgttgcatataggagacagaggtgattaggaccattttaagaatacacaatgctctcaagatagaagttgaaaatcaagcatttctcttctcttcccatagtcatgtcaagtttggcttgaaacttctgtgcatttatatgtcagtgagacatagtaaggcaaacctctaattgataaatctgggacatgccttttaaatggcaaaaaagaacaactactggaataaaacaaagaagtgacccaattgcttcagatttccccgtaggagattccttttgtaaaagaaacacatttagctttagcatagaaactcaagagaagagttttaaaagcttggaggtttttttgtttgctttggtgagtatagtagattccctttatgaagctgctgttaggagaagggactcacacttgtgctacattaagcttttactgcaactacaaggttgcacaggacatgatttgacccttgatttatccaacccatgttcagcacaatcaaaggatggaatattcttatgaactaaatttgatttcataaacacacccattcctcttggtgccatggctcaaagtgttgcccagctggggaattccctctgatgacctcatcccaactttgttccagtgaccctgaaggtctagccgaagtctgccagctccctgaatttgttcctgagggctccagcccacccaacaaccctggcctctccgctacttttctcctcagcctgaatccaagccgccaggtggatagtttatataatggttgcatgccaaaagcagtggctttcaaactgggctcttcaagttgcttccagggtcaccaaaggagagtggggctggatgatggtggacaatggtgcagctgagcacctggggcatgccacacatccctggagctgctcttctctttgtttcacataagcattggggaaagtactgcagctttaaaagactccagagagggtctagaggtactgagcagagtaagcactcaagaatactctatgaataattttgtattctgattaatatatgtaccaattccacaaatatctacatggtaccaggtactgtgttgggcatagatcatgcatatttgaagaaagcaaagtgtgcaccctcaaggagcacccttagcatatgtatctgtcccctctatgtctatgtaaaggcactgcagaatcctaccgtgatggagggtcattaaccccatcaataaccctatctgggcaaaccaagaaacacagacaaacaaatttctagttgacaaaatgttggataaaccaatttttgcaaataatgtcatatggaatctaccaaatttggacaggagggcactactattgtggtagaggcatctggaaagctttgcttattatctagaagtctagaatgaaatggcttctaaatacacgatctgtagctacaaacagatgaacacgtagaacttgccacctgatcagcttcagcttcagaagggtagccattgtgttcttcctgaatctcctgcacagcaccaggtgcatggacaagaaaaggcaaagaggagaaagagaaacacgtgcaaacagacaggtgaaaggacagaatttcttttttaaggagacagtaagcatgtaaaagtcgacacacctttcatgactttgcaaatcacaacattttcccccttggagttaaggaaataacatgtaggccatctatagcatccacagcctaaaatggagtatctattctgtgtttgtgttggggtagaaaaatgaaaagcaaacaaacatcatggatttcaaagaatgtactgtcttttcaaaaccaagcaatagacagcatatagcaaagaaacaaaataacaggcacataatgtgctcacagaaaataaagcataccacagaaaactggtaaagggcaaagtcaagccaaaatacaaaggcagtttatagacatgtattttaaacacagtaagtattcatattacattgctcagggatcaattccactgcacacatgcatatatcacatgctggagattatatatatatgtgtatgtgtgtgtgtgtgtgtgtgtgtgtgtatacacacatatatatacatgtctgtttcttattgcttattgctaattaaattctgtgatttataactcaatatcatattaaatatttctaattactctatcaacgcacttccaagaaacagctaaaaggccacacatctttaattttttccaatccctttaaaggtatactgttcttaatttctttatagaatctattattttttgaaactttaaaaattgggctttttattcagcagctggtaaaaaagaatatgaatactgaagatgacaagattgtaatctctttttaaaattctatcaagtctccgaggctaaaaatattaaaatttagcctatatatatttttgcttcatgaaactttggttgcaatgattatcgtttttacaaaggcaaccagtgaagaactagtaaagctttaaaagaatttactatttcccaccttccatttttgtcaataaagtacaataactccttaatgtacttttatattttatcatcagattgaatttagtacacagttggtatagtttagcatacttcaaggcagtgtaatttttcagtgcagccagttttttgaaatttccattttttaaatataaagaaaatcgagtaattaagtttttagaaacagaaaactcaatgaacaaaaaatacaacatttcaaagttcatgcaagtgtaaagccaagcactaatatttaacagtgtgaatcaatgaaagaaaatgattcccacaagcaaaagaaaacatgatgaaaacaagactaaacaaaggaaaaccagctagaataacaagacttagcttgcttatttttgtactacttcattggcttcaataagattaaaacttttaaactgaagttattatactatcaaaatccacattgttttccttgaatagaaataggttaattttcaatgtctgttaaatgcatgcacattaccaatctttgtcttgctttatgaatgttctgaaataaagggaaggaaaatcatgaggaaaatataagctgtaacccactatatctgtattttaaaaaatagtaactgggattgattttgctaaatttagcttcaagattagcacttctgcttttttggattcaacatgcaaacacaaacatgacttgaaatcttacttagataggacagccaactaacctttttttttttagttgctaaattctgtagcatgaattacacaataaacaagattaaaagagacctcagtagccccagccttataaccccagtcatgaatatccatttggtcataattcatgtagtacaacaaaagtcagtattgcacactggtaacaattttagcatcccgccctcacacacattggcttttattgcacatgaaaacattgtaacaaataaagcgtttctagtgaacactgaaagctataacacagcagagcaaattgatctgagtgattcataaaaaccagtgagaaggtaaagaacactaaatagactaagtgttcgataaagcacagacacacacaagtaggaggcccatccgctgaaagccaaatatccttacccttagatcaggcctcctgaaaacctgttagttaaaatacagaatatcatcatcatggacatgttactattgacctgtgaaagatgccattaagttcaacagcctattccctaagaaacatcataatcctctaagtaaaaccaacaagatcaatcataacacatttgccctctaagtttcattcaatatcagatcaatcctaacacatttgtcctataattttcagggaagtctatgatttggagaaacatgttgcccttaggctaagactaactacattaccttaaacgcaaaccccttctgtcaagtgctattacaagttattgtgaacaggctgtgttcaaaaagttcattagtttccatttggaatactgaatgcattttccccaaaaaccaatgataaaaaaaaaaaaggcagttatatgcccaaaccagcccaggaaaacaaaaccaaaaaaccacagaaatccccaccttggacccagagcaagcacagctcagctatattgcattgatggtatcataaagctgagttacctgcaaagcttaacctgctttctattgaaattacatttccaattcatactggggactccaatgtggccactactgagaggagggtgcccgctccccgccccagcaccagctgcatggccaaaggggggctccacgcgggaagaggtaagtggctgttcccggagaggagggaaagcccagctttattcagcaggcacactgattttagcaacaatattcttgttgtgcctgaggcctgtgaatcctaattgaacatgcagcatacacactcagaaagccctggtcagagggaatggccagaatttttaaaaagcaaatagttgtaatagcctgggaagattttaaccatctctgttccccatttcaaagtctgaaatcctatcttctgaccactgaatgtcctatgaaaacaaataatcagaaaagaatcactggaggttcttactagttttatggtttcactcagaatgcataagatcgcatgatacagattcaaaaaaatcactgtattatcattaaaataatctttgaagtcattaaaaggtatctgaattaagtgatgatatagctaaaagacaaagtctatacataagttactaaacacagactattcagactgagaagcttaaatgtgtctttttttgggaggatggatatgtttacctcaactgtggtgatggctttaaatgtgtgtatttctgtcaaagcttatcaaattgcacattttaaatatttgaggtttatcatttgttaactacacatcaagaaatttgataataaataaaagtagtatatgtttatggtaataactcaaaacagtaagtctcccagagcttcattccccagtaataaccacacttaactagatctatttttaattctgagaattgcttccattgtgatagttatgcttccatttcttgatttgtcaactttaaagtgtctattaacctcccattttaaaagatgagaaaattaactctcaaactactatctccctcttcccaatctctgctgattgaaatgctaattttgagttcttttgttttccttcagcagctgctgcatcataaaaaacactcatgatttttatgtttcagatactcttctaagcactgtattaactcattttattctcagaacaaccttataagataaaaactattatggccgggcgcagtggctcacgcctgtaatcccagcactttgggaggccgaggcaagtggatcacttgaggtcaggatttcgaaaccagcctgaccaacatggtgaaacccgtctctactaaaaatacaaaacattagccgggcttggtggcaggagcctgtaatcccacctacttgggaggctgaggcaggaaaatcacttgaacttgggaggcagaggttgcagtgagccgagatcacacactgcactccagcctgggtgagagccagactctgtctcaaaaaaacagaacaaaacaaaacaaaacaacaaaaacagaaaaaaacacctataactggccccatgttttgatgagaaaaccaaggcacagtttaagtaatctggctgagttcaaggtggcagagcaagcagttaaaccctggaagtccggctctggatttgtgcccataacaactctgctatactgcctcagcatggcgcctctatcattaaaccatttgaactacagccctaaacctattttgaccctcaaatgttaaatatctcttaactcccttcaggttttttgaagaaatcaataccactaacccttcctccacctctctacctcccaacctccattctgtaactacaattaatgtttggatgctttgtctataaattgatagtaaaaactgaaaactaaaaacattcacaacaaaatctttatgaaaatattgtccactgcagaaccaaattgtgcaattgaaccctgatatagtttggacgttgtcccctctaaatctcatgttggattctaatccccagtgttggaggtggggcttggtaggaggtgtttgcgtcatgggggtggatctttcatggctgggcgctgtctttgagctagtgaattaattcttttgagatctggttatttaagagggtatggcacctcccgctgccttgctcccactctggccatgtgagacgtcagcatctcctttgctttccaccatgactgttagcttcctgaggcctccccagaagccacacagatcccagcaccatgcttcctgttaaacctgcagaactgtgagcccagtaaacctcttttcttgacaaattacccagtctcaggtatttctttatagcaacgtgagaacagcctaacacaaacctcatatatgggagttataactccttgtcaataggcctttgccactaaaacgagaaactaacttgaaaaagggtgcaaaggggtgagatgataatctgcttttaaactcacataattctttacttactgccatgaaatcctcagtgttcctggtatgggggtggaggggagaaggtcaatggaggcttacccaaaagtctctaagttgatacctattgtgttttctctggttcaccatgtccctctcctgaaataagccatttcagacacatgcacagagcttcattttcttcttaaatgtgattctgatggaagccgtaggagaataggttgtaagccaggaggcctggaagccagctcttgctgatgatacagagcttcctaatgcctgcattctgggcctcagtttcgacacataaaatgaggggagtctatgggatgactgccaggaccctaccagttcccaactccgaaggattcggggtatctaggcctcattagaagacttaagaaaacatctgccaaactgaggctgagggaggtaagtcggcatagtggttaaaagaacacactccagagtgaaatcccagctccagcacctacttactggccacaggacctcaggcgaaccacacacccaccttggaatcttagtctcctcttctctaaatgggagatgtcgagagcacctcccttgcagattgttggcagggttaaatcagttaagataattgtacctggggtggataagtaacctttttcagttgatgagtctcagctgccccaacttgtgccacaactattttcacatgccccacatcccctccctcaactcctaaacatgtcaagaacctatgagaaggtgcaaaaaaagttgatagtgatcttaatctatttaagaaagcaagcatactgcatcatcttgtcgttaactaaatttattataagaaacataatagttaacttctaacatcttttttagtatatttttcagttgttaaatagttatatatatataactgaaatataactatatatttcagttgttacataaatctaacataagaaacacaatagttaacttctaacatcttttttagtataactatatttttcagttgttataaatacaatgatacaaatttttacatgtaatatagaatcattcagcagtctaaaaatcttgacttatttaaaattaaactttaaattttgggatcattgtagaaccacatgcagttgtgagaaataatacagattccatgtaccagtcacccaattccctcagtcgtagcatattacaaaactatagtacaatatcagaaccaggatattggcattgattacaatcaagatgcagaaaaatttcatcactacaatgaactctactgttgaccttttatagccacatcttactccctccctgctttcctctcttcttggcccctggcaaccactcatctgtctttatttctatcattttgccatttgaagaatgtcatataaatgaagtcatacagtatgtaaccttttggtactgccatttttttactcacgtaattcctttaagattcatccaagttgcctgtgtgtatcattatttctttttattgttgagtaatatagtccatagcatggatatactacaatttgtttaacaatatacctgatgaagaacatctgggtgggttccagttttcggtgattatgaataaaactgttaaaaacattcaggtacaggtttttatgcaaacataagatttaatttctcttggacaaatgcccaggagtacaattgtttggtcatatggcaggtgcacatttcatttttaagaaactgccagactgtgtttccagagtggctgtaccattttatattcccatcagcaatcagtgaataatctggttctccacatttggtgttgtcactttttaaaaatttctaaccattccaataggatatagcgatatctcactgtgactttaatttatattcccctattgagaaatgatgttgaacgtcttttcacgtgcttacctgccatgtgtatatcttctttgttgagatgcctcatgttttttgctcattttctaattggatggtttgatgtttttactgtcgagtttcaaatattccttatatattctaaatactagtcatctgtcagatatgaggtgtgcaaatattttcttccactttgtagcttgtcttttcatcttctcagagtctttcacagagcaaaagattttaaattttgatcaattttttccttttatggattgtgcttttggtgtaaagtttaagaagaatgatttacctagccccagatccttaagattttcttttttctgtaaaagttttatatttttaagtttgtgattcattttgagttaatttttgtataagatgtgagacttagatcaaggttttgttttgttttgttttgtttttttgtctatagatgtccaattactccagcagtatttgttgaaaagcctatctttcaaccattaaattgttttcatgtcttggtggaaaaaaaaaatcggctgagcatatttctgtgggatgacttctaggttctctgctctgttccactgatctatgtgtctgtacctctgccatagtcttgattactgtagctatgcagcatgtcttgaagtcatttagactgattcttcccactttattcttcaaaattgtttcagctacttcagttcctttgcctttccatataagttttaaatctgtatctacaaaaaatctttctgggattttgataggaattgtgctaaatgtgtatatcaattaggggagaagtgacatcttccctatattgaatcatccaaatacatgaacaacactgtgtgtctccattaatttagatcttctttgatttctttaatcaatatttgatagttttcagcttatgagtcctgttcatgtcttattagatttatacttgctatggttggaatacatccccaaaatttcataagaaaatatttgcaaatcacatctctggcaaggtattaatacccagaacatattaaaaaactcctacgtctcaacagcaacaacaaaaaccacaaacatcacaaataacaactgttggcaagaacatcaagaaatcagaacctctgtgtactgttggagggaatgtaaaatggtacagccactgtaggggtttgaacatgtcccctaaatttcatgtattggaaactgaatccccagattcatgttgcctgaaggtaaggcctttggaacgtaattgggattagatatggtcatcagggtagggcttccatgatgggactggtgactttataggaagacggatctgagctagcaggtttgctctatcttgccatgtgatgtctcctgccatgtcatgatgcagcaggaaggccctgaccagatgctcacccctcaaacttggacttcccagcctctagaactgaaagtaaaaaatttattttctttataaattacccagtctgtggcattctgtcacagcagcagcaaacggactaagacaatacctaagtatttcattgttacaatactaatgtcaatggcactgtgtttttaattttggtccccacgtgttgctagtacatagaaatgcaactcacttttgtatattaatcttatatctatattgtcttgtatcctgtgacctcactaaactcacttattagatttaggaggtttttttgcttactgtgttctttcttccttcctggggtctcaggattcctccttttattgcttcctttctgttcagagaactttctttagccattcttttaggataggtatgctagtgacaacttctcttccagttttccttcatctgaaaatgtcttgatttcctcttcattcctgtagcatatttttacatggttgatttttttctttcagcacttggaaaatgttgtgccacttccttctgaccttcatggtttctgatgagaaatccactgtcattagaattaattttccttataggtaaagtgttatttctcttcctactttcaatatttttttctttgttttcagttttcagaaatttgactataatgtgtctttgtgtgaatttgaagggatttctctcatttgggattcactcagcttcttgaatctgtaggcttatgtgttttgccaaatttggggagcttccagccattacttcttcaggtgctttttcagccccatcccctctctctcctttgggactttgacgacatcagtgttagatcttttgttatactcccacaattccctgaggctctgttcatttatctctgttattcaaattgggtcattcctattgttcaattttcaagttcacagattctttttgtctgtcctctctattatggtgttgaacctatcctttgagtttatttcatttattgtattttctagttttaaaatttccatctggttcttctttgtctcttacatttctttgtggaaacttctctattttttttttcattgtttgtttcaagcatacctgcaattgcttattgaagcaattttatgaggacttctttaaaatctaacatctctatcatctcagttttgacatctgttgatttgattctcttttttcattcagtttgagatcttcctcattcttagtataacaagtgatttttcattaaaatctgcacatttggggcattatgttttaagaccctggatcttattcaaaccctttgtttaagctggctttctctgacactgctccaacagaagaggagcactacttcattacttctaggtaggggtaggagtccaggttccgtactcagcctccactgacactgcagagtggagggctcctcgttactgctgagcaagggtgagagttctagctcccagctaggcttccacagaaacctccctggctgagagaaaaaggggtgcctcattgttgcccttgatacggcctctactgacaccacagtagaaggggcaacctgcctaccaatagatgacagtgaaagtcatgactcttcactcagtctcccctgacaccaccaccactgcagggagttggtatgcctcattatagcctggcaagggtggaaaccaggctctcccaactggctttgttggtggggtgggtgtggggtcataatttttttctgtggtgtttggctggagtagagtagttagtgtgttttctttttgctaggtgcccctttcctggtcctctggctagacagagtaggcttttcttatctgcgcctgttggcatttctgactcactggtttcttcagcaatgagtctgggacatacgtggcaaaaacaaacccaggaaactcacaaccatgtcattccttgggtcttgaggtccctagctagtctgccttttctacctttcagagtattcttatgtttattttgcagataatgtccaaggtttttagttgtacttagtacaaagaataagagaaaatacatttgctccattttttccagaaacagaagtctaaatcttaacatttttaagaaataattatttcccacaaaaaccatgataggatagcactcttctatctattacagtggttacaaaactggaggcctatggtttttaaaaaaatttaattgctgttaggtgggcattctgtactctccagttctctacagcactcttccatgtctgcctagatttgtgaactgttccatgaaggcatctgagtttgcaagctctgatttataagtcacaaggccaggctatagattacagaagtagattttgaaggttcatgctaaagcttcccttttcatagactagggcccaatttaagaaatgttaaccaagacccagctcaagcataatgaagtctttcctatactctgccttcgacttccctccaaatgtaattactgtactatcccatccaatgattaaacttagtataaggccatctccattttctcatttttcttcagaatgtttagagaagagatatagctactgtgtgtgtgtgggtgagggaaggagaacagagaagagctgatgataatgatgaagcaagaggaaggaagatgatcacattaaaactatagtgtcctaattttcataaagctggcccagatcaaattcttttgaacacaattgaataatgttctagcaagaaaggcatttagaggtgaataatctaatccaagcccctttatccttccagaaaaggaaactgagcctcagagactatacaaggtcacaagctaaccaatattgtttgtactactccatcatgttctcttttcataacctagtcctactttccaaacaatggaagctgtgatcaatgatgtcacttctactaatagttcctaaaaatgtttccatttgtaactgtattatttcatctaatctacagaagattacattcaaattttgttcttaaaatttctggcaaattcaagagaaattttttaccatttgttagcctagtaaaaatgaaagcaattgagttggtagtggaggggggacaagcaaaacaaatattttattacattttgtgtaatagtcttaattaacaggccaatcttcaggatgactcggtattaaatcaggcatttattaatttagctgccacacaattcagtataatagctatctactctttcagctgggacaatgcttgccaaacttgccatttcacataccacctcaacaagtttggcttgctgtatctgccaactgcccatactaattttgtatttatctttatattgatttaaaatccattcctttttaatactttgcctgctctaagccataacatctactaaatcacaagcctgatgtgctgatttttctaatacacaagaaaataattacatagctactaaaatacgtccatggacataccatctaaactcatgtcacgtgataccagcgatattcttactgtactttagatgagctgaccctgggctgactgacaatttatgatatgagtaaataataaaataattattctccaatatctgagttgctaattattcagattcttagtaatataccagaaatgcagggtcccatcaccaatttcaacagacagaaactcaggaagcctaggttttcagattttatcatgcataagaaatatatgagacacttgtttccctccctcagacactctgattcagtaaatctgggatggagcccgggaagctgcatttttacaggtgctccagagaatgctgtcttgggaagacccaagggtcacattttgaaaaacagtggatgaggctgggtatggtggctcacacctctaatcccagcattttgggaggccgagatgggaggatcgctcgagcccaggagttcaagaccagcctgggaaacgtagtaagaccccatctctataaaaaaaaaaaaaagaaagaaagaagaagaagaaaaagaagaaaaaaaaagatcgaaaagcagtggatgggaatgggggtgggacaaaatcttaaaatcactctagcttttcaataggatgacttgagttcaaatcccaagtctaactgtatgaccctaagcaagtcatttcatctctctaggcctcggtttcctcatccattaaatgatgattgtagtaatagctacctcaatggacttttttaaagaagcaagatctctctatgttgtctaggctagagtgcattggcttttcacaagtgtgaccacagcacactgcagccttgaactcctggactcaagtgatcctcccatcttagccttccaagtagctgagactacagaccaccacacccagattcactaggttgttttaaggcttaaatggatgacatgtcaaaaagcattacaaaaccccagagcctgtatgtgttagagggttgatgatgatgatgatgatgatgacatagaaccattctcgacagcctgttacaactcagaagacaatcagcatttcaaataagatgccaagcattctgctccacataaacatctgctcccatttaattactgatgttgagtttaatctataataaattagcccccaaattaagtgtgtatttcaaataagacatttacacaacagataatttcaaatatcagctgatgactgcaacttaaatcctcaaggaactttatctggctcttcagggtcaaccccatgcaatagctcccatgccagaggggtcccaaaggcccattttggttaccctgattttaagaactactttatagggaacatgtacaattatccttgtggtttagaaatattttatgtatttattatgtaaaaaaaaaaactctccttgaagaaagtgtaacaacccctgagttataaatttaacaccaacttttcagatttggctgcagggcaaatataacaaagacaattataaaacatgcccccttacaataattcatcaaagactttagctatgatctgatgtaggaacttaaaatttaatttccaaaagaaagaaagccttattttttctgaataccatctgttcaaccattccaacatgagctaattcagctacacaaaatttgtaaatagactgagattgaaaaaacttagttgcttcatgttaaagtacagattcagtctgatctattcatgcaatgttagaaagctatgcacacagtcgacattcaatcttttataggacacacacaacactaacaactattcaaccttaatgaaaacattacagttaactcataattgtccataaagaaaatcaccccgaagtgtgagagctattctctgctaaaatgggttcttaagtctctctactcagcgggcagtttctcagctaaggtgcaggcaatagggcaactggaactgatgcgatccgcagctgctcagtgaccagccattcacgcatcagtgatgcagcaaatgcttctcccacctggagacagtgtgtttgcccgaccaggttttaaggtccaggagccccagctgctcttttatgggcaaacatgaacaccacatagcaggaaaaatgattaagaaatacactgtcactcttctagctgggcagattatccaatttctgctaatccacagctatgccttcctttggtaggcataatcaacagcatctgccagtttggatgaggcaagagacagcaccatagccaaatctcaattaattggcctcctgagcctgtttctgcacttgttattaccctatgagctctaaagaggaactgaagataaagctcctaaacaaggagtacctattaagaattaattaggatctttactgtaattcttgatatttgtaagatttgatgtctggcaaggaccatgatattgagagactattaactaatggtagtctgggataccaaatgcattttacacacacttgtgaaaaatcaatcatctcttactagcaggaaaaatgaccactaataaacagaaacctcaacttaggcaaacatcagtactgaaatataaatgtgatttcatttaatatacctattaatagtttattgacattaaaacaaagttagtctttagccttaacaaagatggaacaagcgatttttttgatttgttaattgattcaatatttattgagcaactgttatgctccaggattgtgcctgggaagccagtggtaaaactgccctagtctctgctgacaaggagcttatcacttaaatttagaataagcagggaatctaacttttaaaatgaacaaaaagagattttcacttcagtaaggactgaaaaatgaggctgcccatacaatactcttttgagattctggaagggtttttatacattctagtatcacatgttaatgctgaatactcacagataatacataaattaaaaaattgtgaagttagggaagtattgtacatcaagatatttcctgaaactcacaatactaacaaagaagctatatgcatttattattataaaatggaacttgatttttaaaagaatcattgtcatctaaagacagcttctcctttcaattacaaaactatgactacatgtactggatactggtaaaatttctcttctacatttcagatctaacaacagagaacctttcatccttattctcgagcaaatggccatgttgcatcaaaaggccaacagctcacttgaattaaaactgcaaagcttcttggctacttagcatactgaaaatgaattaaacactcaatgttgcttaccttgtaatctctggacacattttctgatgtcactgaacctgaaatctgactagaaattgtagcagctataagctgtttacaccattcaacatgtgatcctgtgggactaaaaaaaatagcatggattacaaaacgttatatcataggatctcagtgaaaaaattagcactgaataggaatatgataacacttctttttttagatgaactaactagactctttggttaccttcacattttatgtaagaactgaaatagcgactgacaactaggaaataagattagattccaggttaattttaaatgaatcacccaattttctcaaacaaagttgaagattctaggtgttagttaagcttactattctctaccatttaatggaattttactctattaaaattatatggaagaaatacttctttttttttttgtgagatggggtctcactctgtcacccaggctggagtgcagtggtgcaatctcagctcactgcaacctcccaggttcaagtgatcctcccacctcagcctcctatgtagctgggactacaggcacatgccaccaggcccggcttttgtgtgtgtgtgtgtgtgtgtgtgtgtgtgtgtgtgtgtgtgtgtgcgcgcgcgtgtagacagggttttgccatgtttcccaggctagtctcgaattcctgggctcgagtgacccacccgccttagcctcccaaagtgctaggattacaggcatgagccaccacacccagccgggagaaatatgtgaaatatttatcttacagcataggcttttcaaacattcaatcaatttcatgttggtagttttaaatctagaaaatagtgtacttttgagtgaagcaaagtgactcagaaaagtaaagctgaacatgagatttataaattacagcctagaaaaatgatgttctctgtgtagtactaacaataccttacacttctataagtgctttgacaacttacaaatggtttttattttttatttatttttttttttgagacagagtcttgctctgtcacccaggctggagtgcagtggcgcgatctcggctcactgcaaactttgcccttctgggttcaagcaattctcctgcctcagcctccctagtagctaggattatttaggcgcatgccaccatgcctggctaatttttgtatttttagtagagacgggttttcaccatgttggccaggctggtcttgaactcctgacctcaggtgatccacccgccttggcctcccaaagtgctgggattacaagcacaaatggtttttattatatcagagcctcacaaccatggtgtgatgagaaggcagaacagggactagccgacttgtctttgaggagagaaaatcgaggcacagaggtgacatgccctgtgagaaagtggctgtcctcaacaggacatggaacaaccaatagcgactgactcactgcactgaagccagcagcacagatgcgagccaaccgctttacatgaaaacacagcaatgcaaagaaaatgtcatctttcactcccacagagctctgaggcatcaaagcattttcacacacgtagccttgcccagcctcacagtgacccattttacagatgaaaaaattaaggtccagttttgcccaaggtcacacgactggcaagtggtcaggctgtactcacctgacctgaaagaccacataagccaactagcgcagtaagagatttaacaattgcccccagaggccgggttcctctcacaatttggcaaaacactaagaaatcaagctagagggctaaaaacaccgacaaaagtttaccttgcaggtagctttcactgtaaagaatgtttcaggcctttaaaaaaaaaatcatatcactaattaaacccacactcacatatctgaaggacagaaacacctggaatccccaggcaatatggaaaatgacccaaatagtaaaagaaagaaaactgaagttctgtgctagtgatccaaattgcagtctctgatcaaaacagaccagaggttatctgtatggttgaaaatactgaatgagcagaaattcctatcacatgccaggaatctatataccacaatttcgacctgagggggagaaggagagaaaagggagagatttgtttcctttttaaaggttaagtcactttcattcccacgtatatcatacttttcttgtcataatgcctttttctgtcagcacccaccagttgcaaatacaggaagaaactgcagaaacccaactgctgagcatgagtgtgacctgctattaccacctgcctgcccggcatgccttcccccttcttctgataaagaccttcctctttactttgggaactgcccttccccacaacacaggcttctgtgggggaaagcggagaagaaggttgaccccttcctccacctgctcccacttgtaggtgagttacctaggaccagccaatcccagacttttccccttggatcctgaaatacatggatctgtatccagagctgctggaggccactccccaccccaccccacccctaccatcttaaggaactcacagcgattaaaaagtgagggaaaataaaagagagagggagagagagatggggagtcccgacaacactgtttgcaatcctgacctcaactgtgcctgtggccatctctcctcctgtctggagcagttctgtgagccagggcatctcatttgccttaagctagattgaactgtggtttctgtcacctgcaaccagaagcatcctggccaatgtagttacacacagtgaagcacagtgggttagcagacaggaggcctggacatgagtcctgcttctgtcaccagctaactccatgatctttggcaagacacatcctcttacaggaccacagcttcctcattattaattacagtattcagaagagaagtgaaggccccatagtcccagggacatggccaagtcccacccatagagccaggttccattctagaggtcactcttcaaagaaaagtgtgaatctgagcttgttgagctgacagaactgagaaaggaggccatgattcctcccccatcccttctctgtagtctgtgcaattgccctctatactcctggtgtcaataactacttacaggctggaggctcccagctctgtttctccaacctggactctcctgatctcaatgctgatgttcctacaagacctgtccactagtctggcccagagaccctgccaattcaacctgtctaaaccagcatcagccgctcagccccgcaacctactctgctcctgtgtttcctaactcagggcgcagcacagccagttatccggcccccacacgctagaaagctgaggtttgccttggagtccacccggcactcccccctcacatctgaatgctcaccatgtcgggtcactcttacctggtaagcatcttgaaaatccacccagccctattcctagcccaattcccttttccagacctccatcattcttctgtgaactccacctgcctcatgaatttaagcctcatctataagcccatgactccccagtttgaatctccagcccagacaaccctgaactccaggctcagatagatcaactatatctttgacatctattctgggacatataattggcatctcaaaattgatatgtccagagcgaagagcctgctattttctaaccctgctccaccttagaaagacttctccatctcagcaacacaattttcccacaagctaaaattttggaattctcccagattcttctctcataccaaccaaccaatcttcagcaaaccccattggctctaccctgcaggtcttcaaattacatgtagtatctgaccacttctcccctcctccgctccactctggaccaccatctcacttggcttactacaatagcctcctactgacagtctctgcttcagctccttcccctttcactctattgtccacatagcaccatggagagcctactgaaatctacaacagatgatgtcactcctctgcacaaagtccccagtggctccccatggcctctgaggctctccaccatctggctctgtgacttctctaacgtcatcccttacttgtctctccctagctccctccctgctagtgacacctagtctcctcgctgatctaggaacacttggctcacattcacctcaggggctttgcacaggcctctgactagaatactatcacccccaggtatctgtatggctggatccctcgcctctttgggggcattactcaaatgtcagctttctcaggctttccctgatcatcaaaatctctgaaggaaaccagaagatgaggcatatttgggggtgacacattctggtctcctttggcttcttaaatgattctgatgcatgcccatcctgagtacttctgtgttcgcctctaccacctatctcatttatcacattcgatttccactgttggttggtttgtattctccactagatggtaagtctagcaaaatggtaaggcagcaaaagccgtgttgtgctattctctgaatcgcccagacctcgtgtgtggttgaatatttgcagatgagtgaagtcctcaccatttcaagtgctgtcttagctgtgactggttttcagtgacactaaccacttgggtgattaatttattaaaatatattgtaattacactgaggtagaaacaaaagtgaagggaatgtttcttgtttctgtgcttttggaaactcccaaaagtttggcacaatgggatgaccaagacaggcaggaatgggcatgtaaaactgactgagctacattccaacagtgcatgctgcctgagtgcactctggtgtcagggaaatggccaagttgtgggaaaactggatgttccgggttacacgataggccatctcttgtcgtcggaggaggcggtggcccctcccagttcgacacggtcactttatgtttctaactgatttctcttagttctgcagctgcctcagaagcagtaggcttgcttgtgtgttcatgaaaacaataaactggttccctcaaagtgtgaagaactgaaagtaaatggttctgttttcttgcctcctgagcagtttggacgttttccatctcagatttttgcctcgatctgcaccagctcccacgcccgcggggtcccatctccccgtcctcactcccaaccccccatcaaagaccctaagcagccacagcagaattggggtcttaaaaccacacgaggcaaggtgatgctagaagaggagagcccgggtgggatctccctcccaagaggattggtggcctgggcagggacagccaagcgatcgccaagggcagcaggtggcggcgccggaagtggtttgacagctgcgaagcccctcccggggttccaggagctggggctctcggggcggaagtgagccaggtgcgcggcccgcagcaggtccgagggcagcagtccccggatggggcgctgaggtttccgggggtgggggggaggagggcccagaggggatgaagaggggccgcccaccccgccaccgccaggccctgcgcagcgcgcggggagggggcgggctggcctcgcgcggggccctcgggagtcggggcgcgggaggccggggcagcccgggccccgcttacctgtccagggtctccacgctgggctgccgggagccggcggtggcgccccccgcggcccgaggaggcctcctgccgcccgccggccccgggttcgggcccccgccgccctcgcagcccgccgccgccgccgccgccggcctgtccatggcgcgccgagtcctgccgccttggggaagccgccgtcgggacgggagcggcggccgggaaggtttcgctgcttgcctcctgccgcccgctctataccgcccgcccgcctcaggcggccgccgccattagctgtcacctggcggccccgcgttacccacaaggccgcgcgcgcgggggtcggggggcgggagcgggggcggggagggcggcgcgcggggccggcgccgggaacccccacctcgcccagccccacctgggcgctcgcccacggagccttacagcggggatctgggacctcctgctccagcgacctgggtgcgtacagagccactggggttcggaatccccaaacggattatgcgtagcgtgcttcactctatagtcacaccgggttgactgcagagacgtggggtgtaaaaagaagtttgaagacattcaagtatcaaaaatgatttcccacctcagttgtccttcccggaaaaggtatagaacagctcaagctccctcggtcttgacatcttgaagcaggagcaattccgtgcattttagcaattcctccccaccccattcttccctccactctccccctccatacgcaccccgccgccccgccacaaacccacccccttgccatctgtagggcaaccaagtgttctgatgccgccctcggagcttccgcccatggtttatgttaagagtaacatttaacttctgttgattaaaaaatcactgctatgaacatcaagccaatatcttggtgaggcatttaggacatttgctttctgggctagatttatttccttgctcattttgtttgggttcgaatatccaacagctcatcccctctcacctcacccctgattaagttgggagtgggtgtgtggctcgtgattaagcctctttgcctgtgattgctctgggtgtagacaggaggcctgcgacccaggtctggaaaagaagatataaagggaacaatttgctcactgttaaaaggcagatctgcagacagggagttactcatgcccatcccagacccatcctgccccaccagcttaataacttcaaactgaactttgaggatatgatgcctgaagccccgacagccatcttacgcacaagaggaggtgagcctggggtaagaagatgacagagtgaggagggctaggaggaaggaaaggaagatccccagacaataatagctcctatctcacactggagaatcaccgactgcaggttgctggctttctaaaattattaaatcaaatggttaacccactgttatggactgaatgttttcatccccctgaagtccatatgttgaagccctaattccctgtgtgatggtatttggagatggggtctttgagaggcaattaggtcatgagggccaagctctagtctgatggaactggtgctttttaagaagggtcaccagagagcttgatctcatgcactcacatgcacacactgagaaaaggccgtgtgagtacacagcaagaaggtggccatctgcaagccaggaacagagcccttactaggtccctgctggacacttaatcttggactttccagcctccagagttgtgagaaaatttctgttgtttaagccacccagtctatggtattttgttttggcagcctaagcacactaagacacccacttttagttgggtattttgttacaagtagctgcaagcatcttagctgtgctgagaattgtcagaaagaaaacagtgcaactttaagcatattttaagtaccatattctttaagaaacattaggccaaagaggaattcactgtgacactgtcatacttccaattcagttaagtacacttaggatttagaggacagagatgaatctgacatatccctgcctaagatgttcacaatccagtgaaggggacagacaaattaacaatgacattacaagttggcaagtgctataatggggacaattgcacaggatgtggaacacctaccccaatccataggagaagaggaggtcaggaaaacttccccaaaaaggtgacataaaactgaatctttaaagatgagtaaatccttgatgaggcaaaggagtcaagttattccaggcagaaggcacagttatgggcaaaggtgtggattagtaggtatattaatctgttttgctttgctgtaaaggaataccagagacctggtaatttataaagaaaagaagtttattttggctcacagttctgcagaccgtacaagaagcattgtgctggcatctgcttctggtaagggcctcagcaagcttacaatcatggtggaaggcgaagaggaaacaggcatgtcaaatggtgagagaaggagcaagtgaaaggtgagggaggcaccagactctttcaaacgaccagctcttgcatgaactcatagaacgaggattcactcattaccacggggagggcacaaagcctttcctgaggggtccaccttcaggatgttcacaatccagtttgcaacccagacaccccttactcagccccaactccaacattagggctcacatttcaacatgagatttggacggcacaaacatccaaactctatctgtaggttaaatagcttattatgtgcaagagaatgccaagaaatcgagtgttactggagcataaagtcagacaagataagtgaggatctggactggtggtaggccaagaagtttgggctttgttctgcagctcaccagatctcaaatgttagtgtgcaagaatcagccccagtctgcattttcagcaaatgctcccatgattctgatgcggggcttgctgcacttggagaaatactattgtatagtcccccatctacgtccatttgatagattgtgcttccaaagactgctgcaataatatcccccatcccacacactcttttgcaaggtgatcttaccactcatacatcaagaggtggattctgtttaccttctccttgaatgtggactggccctgtaacccctttgaccaatagaatgtagcagaggtgatgctgtataatttccaaggctaacccttaagggatttgcaacttccagtttgctttctgtgcatactccttcttggaagtcagctgccatactctgaggaagcccaagcagccacagggagaggcccatatggaagagaaccaaagctctcagccaatagccctagctgagttccccaggcagcatggccagaagccagcactaactgccagctatgtgagtgaggccatttcaagcctttcagtcattctggtggcctagccaacaccacatgaagctgatgaatcatacaattgactcacagatttttgaaaactaatgaattatggttttaagccactaggttttggggtgattttttgtgcagcaatagagcacccaagcattgctcttgatgaatgatccagagaagtaatcccctacctgctcagctcccttccccattcagctataggaatccatgcacaaatcacagccacactccaaggagggtactccacagtagtaggtcagaagctgttataatctaagattttaccctactagcaagctgaaaatttagttgatcaccacactctaacactctgagagaaaatataaagcctctggatccgaaacaaagacagtttattattcacagcaaaatcagcagccacagcaatatcttggatctgcatcctgaaccccagtctctacagggtggcatgctgttctgcagtgcaaccttgccactcttacattaagaggtggtatcggctgggcgtggtggctcacgcctgtaatcctagcactttgggaggccgaggtgggcagatcacctgaggtcaggagttcaagaccagcctggccaacgtggcgaaagcccatctctactaaaaatacaaaaattagccgggcgtggtggcacatgcctataatcccagctacttgggaggctgaggtaggagaatcgcttgaacccaggaggcagaggttgcagtgagctgagatcctgccactgcactccagcctgggcgacagtgcgagactccgtctcaaacaaaacgaaacaaaacaaaacaaaaacaggtggtacctatttcccctccttttgaatgggggctggcctgtaactgcctttgaccaataggaggctagatagtatctgcacatgtaatgggatacaccacaggagagaaaaccccaacgcaggaaactctggctactagtgacctacccattctcccctgcagggagagagattactcgttaccttggaatgaatgatcagatgtaaacaaatgtcctttgtggagatttacatttactaccctggattggaatgtctcctcataccaactttactaacgtggctgtaaatgtatttcctcagagaaccctgaccatgctgaaaccggagatagtcatggtgaattgtctccaaacacacacaggccctaccacccccttctgcccacatgggggtctagtcatagttgctgggctgactatactgcattcctagaaatcactctaagaggacaggcacatggtttttgtatgccacctggagctggagttgtgtggtgggaggcaaggtgaagagtgacttctcaggcccgtggtgatgctcaccaggaaacaggaaaggcctcctttgaatgcccagctgcactctgcagttcctgctggggaagtgggaaatgtatatgagtatgctgcatgtttgtgacatgtttatgcatgtttatgccatgtttatgtagaaagtagtagttttcaaaattacacgcatgaaaatgacttgggacatcaattaatgtgcagattcatgagcttcaccacagagaatctgaaaatttagtagttagctagggtgggtgctaagaatccacatttgataaagcacctcaagtgattctgatatacatggtttgaggaccacactttgagaaaccctgttagaggtgacaaggagccacagcaagatcttggaaaggggtgaactgatcatatttccactccagaaagatcactaggattgcatgatggaggatggactggaggggcaagagtggccgtgagaaggtcagttaagaagttgttgtcataatcaaggaagacctgatgcatgaaccctaacattggacaggactcagtgactgatggaatgttggacatgaagtgaggagggaaggagatgccaacgtgggccaagcctggcactgaggtttcagacttggaaaactgggtaaaggagatattagccactgataaaaggaatccaagatgacaagcaggtgggagaggtcagtgaccaggatgaattcattctagacatgttgagcttgacccaccctaagtccaagcccataagttgcctttgtgtatattagaaaaaagaaaacccttcctaacaacactggacttctgttagtcataaaattgtcatagtataaccaattttgttaaagctcaacctttggctgccatatgccaagagactgccataatagacctagaaatctatgtggacctcattctgaaggatccctgtcttagtctgtttgtgctgctacaacaaaataccacagactgggtaatttagaaacaatagataacaatagatatttatttctcacaagttctggaggctgggatgtgaaacatcaaacctctcgctggtctgggcctggtctctctgcttccaaaatgatgcctttgttgctacattcttcagagaggagaaacgctgtgtcctcacatggcagaaggtaaaagggtgaacaccttctgttaagcccttttataagggcactgaatctcattcatgaggacaagccctcatgacttaatcacttcccagcaggccccaactcttaacaccaccaccatggggatcaaatttcaacaagtgaatactggggacattcagaccatagcagtcccccttagatgtggcccccttgtgcacttcacaacctgtgcaacaatgcatagcagtcttggggggtacctatgggtatccaagtggagatgtccagtagacagttggaaaggaactcaggaaagagaggtaataaaaagttggctaattttcgtaaaatttgaggacagaggaactctttgtaatttaaccttcagcttcacgatttggaaactacggttgggatcatcactttcatttcttgaaaacaaattaagcaaatgaaagtggacctgatcgtcccttgtaaaataaatttctcaaaaacataattttgctaggactgagcaaagctaatcctcaatggaattacatgtgactgcactgcagagaaatgttcccatcatttggagggtttgtagtgtcagctcaaaagagcagggcttctgcccttatgaatgggttagtggattatcatgggagtggaattggtggctttacaagaagaggaagagaggcctgagcaagtacgcctagcttcctcaccatatgaggccctgcactgccttgggatgcaacagcgttcccaccaggaagaaggctctcaccagatacggccccctgacctatgacttctcagcctccagaattgtaagaaaaaatttattttctttataaattatctagtttcaggtcttctgttgtaagcaacagaaaatggactaaaacaataaactacagaaaaagcaccacagatgacttaactttgcctttagaagttatctggaaggttctcagccacaagttcaattattggcaaggctaaaggatgcctcgggaggcttttgccttcaccacccccatcatctccaccattctttgatgttgagattcctgtatcctcagtcttatgacaggtgctctacaatgcagtgtcaagctcaccttcacacagagactgcggtccagagacctcatactctcaaagctccagagactccacttgcctcaacctggcaagcatatttcagagacacactttttgccccactcagtaaacacataaatttctcccagataaattcccttaaggcagccacatttaagcaagcagctgagatatagtggtctgcaaaggagggagaagagtccaaaataggaggaggtccaggagatgaggttgtcaatgaagtcaaaggaagaacattgtcttcagaatcaatcttgaccttgggtgcctgggtggaaagtgatgccagtccctgagattaaaaaataaaaataaagaataaaaaaagaaagagaagctatttgaagtggaagagcctgtaacatgtccaggagtgacggggtagatgggtctggtgcccaggagaaaggccgggctacagatttcagcctaaaggtgtaaaacctcgagaggcagaactggctagctgtgtaatgtgtagggcccagggcaaaatgaaaaatgcagggtaccttgttcaaaagtattacaaatttccagatggtgataggaaagcattgaatcaggaatggggcctttctaagcatggggccctgtgtgagtgcacaggccaaacacccatgaagttggccctgatgagaatgtgtaaatttgcctggggaaaacatgtaaaatgagaagacaagtgagccaaggagacatactagatcattggcactgacagggcaggtgaaagaagagcggcccgggaagagctcggggggttggcagagacaagcaaagagtcagggcagagggggcatgggagccaagaaagtcaagagttctaagatggaaagagtgatccagagtgtcaagtgttgctgggacatctggtaagacaaagaagtgttccctggatttgactgcaaggaggtggtgtggactctgctgagagcactcccaagggacagaaatgtctgggagggcaaaaagagagacagtgagttcagaccacctagtcacaggttttgagttgcatggaccaataaaatgaaaacaaaaccgagacccactgttgttgttgttgttgccattgttcttgttgccattgttgtgtgccaggaccataacatatgactgccaagtaaggactgtgtacatgaggctccatctttgagaaccaatgttgaagccttccattgccctgcttgccaagtagatgtcagctggagttagggggatccttttcatcctgagcaccaccacatggggctcaccaaaagtggggagaaaaacacacagtctctttgccacctatgcagacagccgtcaactcagtctgggcttgggcagtgatgctttgcagccctagggtggactgggcagcaggagacctggactccaaagctggactgctttgtaaggccttcagcgcagagttttaacactcttgtttgaatgttagagatttttcaaacgctagagatattcacattcaaatataagttaaaacatcagatattatatatggattatccatttctctaagtctgaaatagcatagtaattgacttgatgtaattagaggctgaaatttatagacagtaaccatcaggtcttaggagaggtgtgcagatgtgtttagggatgagaaagataaatgcttttcttggatgagattttgagtccattggagaagcaggagcatggactatattttccattctttattttcaatctttgtgtatctttataggtgaagtgtgtttcttgtaagcaatagtttcttgtagggtcttgttttttcatccattcagtcactctatgtcttttgattacagagtttagtccatttgcattcaatgttattatcgataagtgaggactactcttgtcattttgtaatttgtttgctgtttgttttgtggtgttttcttccttctttcctgtcttccttccttctttcctttaagtgaaggtgattttctctggtggtatgatttaatttcttgctttttttacattttgcgtatttgttgtatatttttacatttgaggttaccatgaggcttgcaaatactatgtgataatccattattttaagctgatgagaacttagcactgattgcataaacaaataaacaaacaagcaaaaagagaactaataaaaactctacattttaactttatctgcctgtttttaaactttctattgtttccctttgccttattgtattgcctatgtcttgaaaagttacagttattatttttgatttattcattgtttagtctttctacttgagtgttttacacaccacacagtcttataatattctgtgtttttctttgtgctattaccagtgagttttgtacctttagataatcccttattgctcattaatatccttttctctcagattgaagaactccctttagcatttcttataggacaggtctggtgttcatgaaatcgctcagcttttgtttgtctgggaagatctttatttctccttcatgcttaaaggatattttcgctggatattctattctagcattaaagttgtattcctttagcactttaaatacgctatgccacactctcctggcctgtaaggtttgcactgaagagtctgctgctggacttatttgggctccactgtatgttatttgtttctattctcttactgcttttaggattctttcttaatgtttgatctttgggcgtttgattattaaatgctttgacgtggttttctttgggatgatacatgcatgggcctagctcaaaagaaagcatgtgcataggagcccagcaacagagaaagcaagctgtgctctggaggaggcaaaaagatgaggcaccccagaatctggaagataaaacttttttctcctctggtctctctctctctagcgccctctactgacaaggatttacattatgccagctggtaagaaatatttacaaagcccatctccattatcacagagcagttaaaggaggatgcctttggagctgagaatgcattgataagtggcgtggacactcacagacttactgggttgaaagaaacgctaatctaatgtcttcctatttccaatccacatcccacttgatgattgaattcctcctacgaaatcctaccaggcagtgcttctacaggtgtagggccaaagaaagaaatctctacatttaaagcctatttatgtccagagtatcaatcaatacaacacacctttccaaaaggagctaactctgtaatcagtgattaattctttcaatgacatctatttaaggatgcaatttgaccaatatgtaggtattgcctgaaatagtcatttctaaacacttggcactgggccagctgcacaaaattacctggggtgcctttaaaaaaattaatagacctttctttgtgtagttttaggtttcggaaaaattgagtggaaattatagagaattcccatataccctctcacagtacgccccaccccccgtcccagtttccttattatcaacatcttgcattagtgtggtacacaagttacaattgatgacccaatattgacacattattattaactcaagtccaccgtttacattagggttcattctttgtgttgtacattctatgggttttgacaaatacatggtaatggcatgtatccaccattatagtatcataaacaatggtttctggtttcagtgctctaaaaatccccggtgctccacatactcatccctccctcttttcctccctccctctccctgaacccctggcaaccactggcctttttactgtctctacagttttgccttttccagaatgtcacatagttggaatcatacagtatatagccttttcacattggcttctttcacttagcaatatgcacttaagtttcctccatgtgttttaatggcttgataggctcatttccttttagtgctgaataacatttcattgtctgaatgtaccatagttttgtttacccattcacctattgaagaagattttcactgctaccaacttgtggcaactaagtgacaaacatggggcatctgctggaaacgtttgtgtgaaggatttgcctagacataagttttcaattcatttggataaatgccaaggagcatggttgctgggtcatatggtaaggctatgtctagctttgtaagaaactaaactgtcttccaaagtgtccgtgccattttgcattcccaccagcaatgaatgggagtttctgttgctccacattctctttttttttttttttttttttttttttttgagacggagtcttgctctgtcgcccaggctggagtgcagtggtgcgatctcggctcactgcaagctccacctcccgggttcacgccattctcctgcctcagcctcccgagtagctgggaccacaggcacccgccagcatgcccggctaatttttttgtatttttagtagagacggggtttcaccgtgttggccaggatggtctcgatctcctgacctcgtgatccgcccgcctcggcctcccaaagtgctgggattacaggcgtgagccaccgcgcccggccctgttgctccacattctcaccagtatttcatgtcgttggtgctttggatttggccattctaataggtgtgtagtggtatctcattgctgtcttaatttgcatttccctgatgacatacgatgtgaagcatgttgtcatatgcttatttgccatctgtagatcttccttggtgaggtgtctgttagtcttttggccatttttaaattgtgttgtgtttattgttgagtttgaagggttctttttatattttggataacagtccttatcgaatatgtgttttgcaaagatttcttcccaatctgcaacttgtcttgtcattctcttaagtatttttcacagaagttttaaattttaatgtggcccattttgttaattttttctttcaaagattgtgtttgagctttatatctaaacactcattgtcaaagtcaagatcacctagattttatttctttaaagataattttcatattcatttttataatctgcctccagcaatgttctagtacatttttaattatcagctctctgaagaaagacaaagcctttatttgtagcatttgctcatttctgtggtgtaactcttcccagcttggccgatttcaaagtaccaccttgacatcactgaatacagaattaggaagagatgctcacagttgtctctgaccaacctatataagccaactgcagcagaatgactgcttgtgtctgataatttgaataatctgaagtcttacaagtcgttttctgcttttttgtttctattgatgttcgctgaaggctttctgtctgctatttttcactgagagatgttcaatttctttgaaaaatgatttgcgagaattcttagaggctgcgataaaggtgtgttcctccatagagcatttgcttccaccaggcacctgggggcaccacaagactggtgcctgaggatttttgaactactgaggtgaagtgaatttgaactatactggaaagcctgctagtgagcaccacttctcagggacatttgaatcttcttccctctcctctgctctgggccaaacagttttccttacaggcctctgctatcgtgggtatagtgggagtgtgtaagaacgtcgaggtaatcaggcatgaactccctcaaattcccccttgtgttcataccctatggttgctgtaacagattacccaagcttagtggcttcaacaacatacatttattatctcactaattattattaatattatattaatcatttattatttctggggatgaaagtccaacccaggtctcactgggctaaactcaaggtgtgggcagggctgtgttccttctggaggctttagagaaaaatctgttccctgtcttttccagcttctagaggctgcgcggtccttggctcctggccccttgctccatcttcaaagccagcatggccagtcgtctttctctcatggcatggctatgactctgaagtctcttccacctccagcttccacttttaaagagccttgtaatgacattgggttcacctcaataatccagatgatctcctcatataagggtcagctagtatcacaaccttaattctatctgctaccttaattcccctttgctatgtaacctcacatattcacaggttctggagattaggacatggacatctttgaggaaccattattccctccatcagtgtttcttcatctgcacccaccctcctcttctctagttgctgaggaagaggagtcctttctgttgtgcaaagcaaatccccctctgtgtccttgggctcttccccactctgaggccttgttcaatcaggtaacagctccctcttctctatgcaatctctcattcgccactggcttcttcccgatgtatgatcccaagaaagtctcttcctttcaaaagcccattctgtctgtctcatttctcaacagttattatccaatctctcgcctttctttcttttttttttttactgtcaatcttttttattatttatttatttttaaattttattattattatactttaagttttagggtacatgtgcacaacgttcaggtttgttacgtatgtatacatatgccatgttggtgtgctgcacccattaactcgtcatttagcattaggtatatctcctaatgctatcctccccctccccccactctcacctttcattatagcaaaccctctagaaagagaatcccactcttgtgtacccttcgtgcattcactcactaattcatgcattcaaataaatatatatattttgcacctaccatgtgccaggcagcctattgggcattgtagctaaaaacaaggcagcttagagtgcagtgaaaaagaaagacattcatttcaacaaagtatggcaagtgcaatagtaggagaggtataaggccctgagggagcatagagcgctgggacctaagatagtattgaagggaggggcactggggaagagtgccataatcaagtcgcatttaaactgatagggctcacaggtacttgttgaataaatgactgcaggaggtggggctattcctcttcagtttctcttttctcttcactgttacacggcccttgccctaggacctagaacacaggccatcgcatctttttgcagcttagtggtgctaaagcagaccctggtgccaaaataatagtttctcaaactgggtgcgcttccggccttttgcaccccttagctgcttgagctagaatcctggctggtgacttttaactcgctgttctttgacttctgcctcaatgaaagagctcttgcgaatgtcctccagggacgtcttactttccaaattgactggacatttttttttatccttgattcaccagatctcccatgctaagcactcactccttgaaattatccttcttttaccttccatgatgcaactgtttgcttctgcacttatctgaccttccttctccatctcatcccaagtctcctcttcctctgtctgtcccgtacaatctggagttggggcgtgccacttttctccatttacttgcatgggcaatgtcatctacttccatagttttatccccaaatctgtgtttccgacttcttttgtgagcttcagagctaaacttaaccacatcttggacacctgttctcctcacattcagcatatcccaaactggcctcagcattgctctagactcgatcctctcctgatatcctctatttctgaaaattataccacttgccaaccaattgcagccaccagcaacttcagtaccatctttgacttctttcttgtctctttttttcagtcacaaacttaaaaaaaaatttttttttcaatctccatctctacttgtctctattccaggctcagttctccccatctggtcaactacatcagcctcaaacttgcctttctgtccccagccttgccaccctaaaatccatctcccacccatgacccccaaggcactccatgacttgcccctgcctgcgtctcagtcatcttttgccaggcccgttcacattacgactcaggaatacctgcttgctttgagttccacaaatgctgcatcctacttaatgcaccatttgcttctgctcatagtgttcccttctatggtgatggtttctttgcttttctttgctgttttaccacacatacatcccaaaacatgaatttagtttgtttttgaacttatatgaatggaataatattgtatacagtggttccccccttacctgaggtttctctttccatggtttcagttacccatgataaacaatggtctgaaaatattacagtatttcaagaggggaagagtgggagagaaagggagagaacacagttatgtaatttttatcacagcatattgttataattgttctattttgttattaactactgttaatttcttactgtgtctaatttataaattaaactttatcatagttatgtgtatataggaaagaaacatagtatatatagggtttggtactatctgtggtttcaagcatccattcggggtgttggaacatatcccccatggataagggggagctactttatattcttttgtacctggcatcttttagttaacatgcttatgagattcaactgtgttgcatgtagctgtggtttgatcatttatcctgggcgtgtagtattccattatgctagggatggtgttgaatctgtatattgccttgggtagtatgaccctttttaataatattaattctttcaatccattagcatgggatatctttccatttatttgtgtcttcttcaatttcttattattagagttttacagttttcagtgttcagagctttcaccctcctggcaaaatttctaagcattctattcctaagcattctattctttttgatgccattgtaaatgggattgttcccttgatctcttttttggataggttgttatttgtgtacagaaatgcaaccggtttttgtacattgatttttctatcctgaaacttcactgaattcatctactagttctaacagcttttttgtgtgtggagtcttttgggtttcctacatataggatcatgtcatctccaaatagagataattttgggccaggcacagtggctcacgcctgtaatcccagcactttgtgaggctgaggtgggcagatcacttcaggagtttgagaccagcatgggtaacatagtgaaaccccgtctctacaaaaaatacaaaaaaaaaatagctgggcttggtagtgcatgcctgtagtcccagctacttgaggggctgaggcaggaggattgtttgtgcccaggaggccaaggctgcagtgtgctatgattacgctgctgcactccagtctaggtgacaaagtgagaccctgcctcaaagaaaaataaaaacagagataattttacttactttctgatttgtatgccttttagttttcttgtctgattgctcttgccagttcttccaatactatgttttgtttttgttttcagagacagggtgcagtctctgaaattgctctgtcattcaagctgtaatgcagtggtgcaatcatagctcactgcagcctcaaattcctgggctcaagcaaattcctgggctcagcctcaaattcctgcctcagcctcctgagtagctggagctacaggtacacaccaccatacctggcttttttttaagtagagacaggatcttgctatattgcccaggttggtctccaactcctagcctcaagtgatctccttgcctcggtctcccaaagtgttgggattacaggcatgagccactgcacctggcactgtgtactacgttgaatagaagtggcaagagtgagcttctttgccttgtactggatcttaggggaaaagcctttaattgttccccattgactacgttagctgtgggtttttcataaatggcttttattatgttgataaactttttaaatataaactatcaagagtttttatcataaaagaaaggatgctaaactttgtgaaatggttttccacatcaattgagatgattttatggtttttatctttcattgtgttaatgtggtatattacattgatttatatgttaaaccagccttgcatgtctacttagcttccaaggctcagttctgacaatattgccaagaagttcctccctagttccctatactggcccagaagtccaccatctgtctctatccttgcaggcagcaccctgcttggaaattactggttaactggattgtcttcccactaagccagatgctccttgaaggagcctactgttttatttatttgtatttcgacagctggcacgggtctgtgttataatagaaaatatttgttgaagtgatcttactttaaataaaaaatacttctggctctgagcctctctcatttgtaaaatgaccaaaaaattatgatcaattttataaggttatggggaggctaaatagtacagtgtttggcacatatggcccaaattaatagctccctttcttccatttagagaccaagggagttgaagtacatggtctggggctttggatagaagcaacaatagaaatagagaataaaactgaaggcaactgtaagtgtaaattttgtctgagatataaggaaatgaactagtcatttacctaattataattgcatagcttgtaataggaaagcctagcagtgtctgatttctcaccttgcatactctctgaccatccaaagctaaaggaactgaggtgtggtaggcaccataatgcacccccacacacaagttgcccacagcccaatccccagaacccgtgaatatgttacaagacaagaaggaattaaggttgccaattagctgaccctgagacgggtagattattctaggctatacagatgggcccaatgtatcacaaaggtccttaaaagtcaaagagggaggcaaaaagagagtcagagacttgaagatgttctgctgctggctttggagatggaggaagaggccatggcatcaaggaatgcaggtggccacgagaagctggaaaaagcaaggagaagaattcttcccttgagctaccagaaggaacacagccttgccaacatcttgattttaaccgtgagacccatttcagacttttggcctctagaattttaagataatgcatttgtgtcttaagaagtcactaagttcgtgaggatttcttacagaagaaacaggaaactcatgaggcaaatgccatcttgtgtgataaatatttcacatgcacatgtgattaaaatgcatttttgagaacaccaaaacttactcttctccaactgtaactttgcacccattgaccaacttctcctggtaccttctttcccactaccctcctcagtctctggtaactattctattctctattactatgagatcaactttttaagattccacatgtaagtgaggccatacagtgtttgtttttctgcgcctggcttatatgcatacattgaaacatcacattttacctcataagtacgtacaattacaatgtgtcagttataaattttaaaaaaattaaaaaggtgaatctctgcatgaaatgtcattaaaaatgcatttctgagaagggctgtgtttcagttgtaaggaaactttgagaacgtgcagcccacaccctcactgagcagatggaggctgaggccttctccatatctgtagcatctgggagctaggaggacttcactcacatctttccttcaggaaatagggccacaagtcagtgctggtgccgatgagaaccctggtttccacacatcccatccaggattctaatatagctttgtgatacagagttcataaaatgtaagcaacttttataatttgcatggaagccactgtgaaacaatttcagaaccactgtaaatgaataagcagcgctctcaaaagccggagaaacaaactgctaaggcttaatggtcgtgtctaagcattgaaccactttatgtgtttaaaatatgttatcaccttcgattttaaaggagaaattgcaaataagaactaatccatgtctgaatctaagcctcataagaaagtgagaatactgcattttactaccctttcctcttccaagtatgttcaatatggaaggaagaccttgataacaaccccttaactttaaatctaccaatgaagtttggcatgtcagactacttcaaatattggtattctagcttcatactggtagtggttctgtaaacctaaaaaattcaactgaaatgtagttcaaccatgtaacgcttttctgcaaatatgccattattcttgtttgtggggtgcgcactgcatacatttcccatttctctcgggtgtccccttttgctttaatggccaccagtgggtgcatcctccagtaacagctgtatacactctttaatacattcccacattaagaatttccttttagacagtcctgcttttgcctaatgtacccaaatgccacaagagttgtctgaatgacaccatagagctgcattatgcaagtgacaagatactactcagcttattctgagactttttgaatattattccctccaagaaagcaaaaggataagctttgctgcattatcaaaaacaggtcagaaagtgctatgactatatttagaaacaaaacctatactaaaaagtatatgattccgaattatttgaagagttgtcccaggaagagaggttctttcaatttcaatgaagaaggcagagctcaggccattcagtgggaactcaaatgtagacttcaggctaacaccagtatgaaacttgtggtggtgctgtaggacgtggggcatgtcagtgaacgcctgcaacaacagcattctcctcagtcgaaaaataggggtaacagaatgccccctagctcataaggtcctagtgagggttcaatgaggcaatgtctgaggaaggacttcacaaagcacttcaaatactcatcgttatgaaagatacacttagtcatttaagagtcctattctgattttttttctttaagctctgttccacgtgatctattctgattgccaaaaaatggtcaattttagtttactgctacaactattcagcattcttagaacgtacatatgtaaacgacataatctccaactggcaatattgtttgaagaattttaaaaattcttacctaatgagacgtcaactatggcttatttaaccagtatcttcgcatcccttactatcaactgctgtgttccctattcagagcctggagttttgcgcgttcacttttgcaaaagccatcctcatagacagtcgtgactcttaaaatctgcactgtttaatacacttaaatgcccaatcttgctgaaattttgggagagccctgcaaggttgccggtgagataaaaagtacatgaagcagacccgggcaaagaaatcagatggccaccatgcacatttccaacacatgcacactcacagccctgaaaacagtgttaggtttcagttaatacatttattacagcaggtctttagtcattattgccattaaaaagttttcatgaaatttcacaaaatcttttaggctattagtattagctttctttttatggagtgacactttgttaatttatgaaatatttacagcatttacaaaaagtaagagaatgtctaataaaatttcttatacttacaaaattcatacattatactactgtatttgagatgtcttacttggtagaccaattaaactatgacataaaataatttacaaagatatatttaatctttcttaattcattgaaaacaaaaccatattagttataaatagtcctttacaaatcattgtaaaacacttcattgttttaactcgagccttagcttttacaaatatacttaataaatgaattagttcagatagcaaatagaactgtgcatttaaaatttcacttaatactataaaacaaaacaacctgaaaaagcaaacggcctggtacttcaagtaaaaatttgtagaaccagtttttatgcacgcgtggggtggggaggggaagccaacaccattgaaattgaaatgcataaacacaatactttcaagaatacgctcaacacatgtacatctggggcactgatttctaaggatgatgctctagcaatagctcatgcatccaagacggtagccctacattttggcagatgagctggactgactagagcaacatttgcgaaaacattcccctaagcagcaggatgctcccgacatccttggacagtgctctctttggggtttgccacaacccgaaaaccattccgaattttaggcaagctcatgaaagaatttagaaaataaaactggcaaatttaaaaaatgcaaatcatatttaactgggccctgtcagttttttaaaaatataaaaataggcttctctggaaaattaggggaaaacattttctacccctaaatttccaaataatgaaaaactcatctatacagctatttctccttaagtcaccactcatgatggtataaaagctggcaattacttaaacaccttgcttttgggtaatgcctaggaagctgagctcaatttggttttggcagtaacatgcatctttcacatttggattcatcttagagaatccaaagcaactgttaagcagcttcaggaaaatccattccacaaacatatatcccctttgattttaaaataatgttgtttcaattaagcccacaaaatatatattgtatatatagtatttctcaagacgtaaattaaatctaaattttgtctttcaaaaactgctttttaaaggtgtcagggttttccaaaacctcatctcagctcctttcttctgattgccgtgtggaccctgtagttttcttgtaatatgtattctagaaggcacatattcaagagtttaagattatgttagttcaagttctacatggaggcaaatattttaatctactttttacaaatgccccaaatgaaagtcagctatcgcctttatttcgagctctaatgcggtgccagggtcccccctcagaagtgagtttgcacatggggcatcatttgcgaaggactggaaggtgaagttgggggatcagaaagcttggcagagttggcgagctgcagttcctcaagccgctttatgtattcgtcgcgtaaggctaagagctccatgtaacgctgctccactggattcggctgctggagagaaccagagacttgagttacactttatgccacgcacgtcatgagaactcacgtgttccacccatctgctgtgactgctgatttgtaaataagccctttactcaaagtttaccataatacatactttccttaactactgcctcattgacacatacaggaaagtacaacacagagtactaaacacccaagtactaagtatttgttcaccaagaaatacctaatgtacacatttcctcacacgtgtcactatctttgaaaatgtgtcagccgagacacagctccagtctcccgtgttgcccgtcccagacccactgtcctctttcactctgagggacaactcttctcaagttgccatgtgaccttcctttttgtgcagatttgtgacacttttcctgtgagtatccagcaacaaaatacagtattactttgtgttttatcaaagtttacatcactggtaccatctggtatttatcaattgacattttgacccaacatgttttctgaatttcatccttgttaagttgcattgaaggaataaaccagtttctccaccccttcccaggctgatgggtaatcagtgatttccagggctcctcggtagtgtgttcaatgctgtactgagtatccttgtacacatctcctcaagcacatatgcgagtgtttctctaaggaattttcctaggggtggaactgctgagaagtagaatatggtcttttcaacctcaccagatgctgccaaattgcctgcagagaggctcctgctggtgatacctggcagttcccattgttctgcattctcactagaacttgggagcatacgattattattcttttttccaatttgagggctgtgacatggtatgtcacggtagttttcgtttgtattgctctgctagaacatcttttcatgtgcttattgcccatctgaatacatggctgacagccatagcggctctgcaatgctccgccttgggtatgaatgctgggtttgccccctcaccttctgtgtgcctccatttccctatctgtaaaatgggaatcaaaacagcatagccctcacatggcattgtgtgagtgaagtgagttaatagcatctgttttgctacaatggtgactactttgatgagtaaacaagggattgatgttgatacaaaggcagaagtcaggctggagcataacgtgactctcccagcatgttaagttttaaaagttttgtactgagatataaaccacacacagtgcaaaatcttcagatgttcagctcagtgaatcttgacatacgtatacatttaggtaatcacacccaggtcaagatatacaacagaacagtactccagaaagttaatgttttgaagggatcaggggcaagcactttctagaaagcttaagcaatatatgaagaccttaatgtaaaacccaaaaccatgaaaaccctagaagaaaacctaggcaataccattcaggacataggcatggggaaagacttcatgacaaaaacaccaaaaacaattgcaacaaaagccaaaattgacaaatgggatctaattaaactaaagagcttctgcacagcaaaagaaactagcatcagagtgaacaggcaatctatagaataagagaaaatttttgcaatctactcatctgacaaaggtctaatattcagaatttacaaggaacttaaacatatttataaaaataaaagataaacaaccccatcagaaagtaggcaaaggatatgaacagacacttctcaaaagaagacacacaatgcggccaacaaagatatgaaaaaaagctcatcatcactgatcatcagagaaatgcaaatcaaaaccgcagtgagataccatctcatgccagtcagaatggcgattattaaaaagtcaggaaatgatagatgctggcgaggctgtggagaaacaggaacacttttacactgttggtgggagtgtaaattagttcaaccattgtggaagacagtgtggcgattcctcaaggatctagaaccagacataccgttagacccagcaatcccattatactcaaaggaatataaatcattctactataaagacacatgcacacatgtttactgcagcactatttacaatagcaaagacatagaaccaacccaaatgcccatcagtgatagactggataaagaaaatgcagtacatatacaccatggaatactatgcagccataaaaaggaatgagatcatgtcctttgcagggacatggatgcagctggaagccatcatcctcatcaaactaacacagcaacagaaaaccaaacactgcatgttctcactcataagtgggaggtgaacattgagaacacatggacacagagaggggaacacacacaccagggcctgttggggagtggggggtgaggggagggaacttagaggatggatcaataggtgcagcaaaccactatggcacacgtatacctatgtaacaaacctgcacgttctgcacatgtatccccccacccttttttttagaagaaagaaaagaaaaaaaaagaaaaaagccaaacgtctacagaagtgccttccacatgtagtggtttccagaaccatcctgctttctactgtgttgaactatttgctgaagctgtgcacaccaacaaggaagctgtgaagacaatgcactgatgaagaatgctgcggtttagtattacgtttctgttttttttttaaagagacagggtctcactttgttgccaggctggagtgcagtgcaatcgtagctcagcaaaatcttgaacactgtaacctcgaactcctgggctcaggcgatcctcctgcctcagctggccaagtagctaggactgcaagcatgcactgccatgcctggctacttaaaacatttttttttttttttttgtagagatggaggagggggtctcactatgttgcctaggctggtctcgaatttctgggctcaggtgatcctcctgccttagcctaccaaagtgcagagattgcagatgtgagccactgtatctggcctggatccaatttttaatgttcaggagaatggtctctattagaagcagacactttctagaacctgtatcctagagaagggagcatgagccatgaggttgccctaaaaaatttaacacaaacttgcgtggcttttaaaacaacagaaatttactctctgatggttctgcagggcagatgccccaaattagggtgtcagcagggccatacaccctctggaggctttaggggagaattctttttcacctcttccagcttctagtggctccaggtgttccttggcttatggcagcatcgctgcaatctctgcctgttttcacatggccttctctcctctatgtctgggtctcaaatcttcccctcctttctcttaggaggacatctgtcattggatttagggcccacccaccctaaatctagaatgatctcatcttgagatcctaaacttaatcacaactgcaaagatccttttcccaaatatggtcacattcacaggctgtgggtcgctgtcctttgggggacacaccattctacccactacaggcagccaaggcgtgaatcagctaaagccaggtacaaatgcagcagacatggaaccgtgcccacatttctactgcgattgctgctttcattagtgctctggttacaaaggcccataggattgcagaagcctcttaatcccattctccctatgatcactgtgacttttagtgtgtggcctggcagtggaagcttttcaaaaatgcatatatagcattacgcttggtagaatgcctaacacccagtaagtgctgtgggatgcttgctaatatcctttgcccatttttctcttaaaattcaactgagggccagacactgttctaggtgctcaggatccagcagtgaacaaaggaggcccaaatacctatttttatggcctttatcttctagcagggggagacggacaaacaacgaacataacgatcctgggagtttcacagaatgtttgaaggtgatcaattctacagaagactagagcagggtaacaggattccactctaaactggatggtcagagtgagctgcactgaagaggtgacttttggggaaagacttaagggagatgaaggagggcgtcaagtggatacctgagtgcctgaagaagagcagaggccagtctggctgaagctgagcatgtgagaaaggttgttggtgaggatgccaggaggtcacagaggtaaggggtggggtggcagtcacacgaggtttcagagaccattgtaaggacttgcgccttgactctgggtgaggtgagcagctacctggccagtttctagcaggcgagtggcatgatctgctttggctgccatgctgagaagagtagaaagaagtaaaggtagcatcagggggtccagctagaaggttatcgctgccacacacgggagatggcaggcagcacacaccagcatggtggtgggagctcagtgagaagtgcttggactctagctgtgttttgaaggcagagcccaagaagctctcctgacagattgattggacatggggtgtgggagagaaaggtgtcaaggatgactctaaggttcctgaccagggcgactaggctggcgctaccacgaactgaaatggggaagatggcaggaggaggaggttttgggggaaacatgaggagttctgttttgacatgttaactttcatttccagtcccagcaccatttactgaacattccactcatagggatgtgttacattgccaccttcttactattccaagtctccacattgacgcaggtctgtttctgggctctactctgttccaaataagtcttgctatatagcagggcaggttcttccttgatattctcctccaaaactgtggctatttttaaaacctccctttgaaatatgagtattagaatttagaatcagcttgaatattacaatgagcatgtgcaattagataagaaaaagaaatcgggtaacagtaatttttgcagatggcatgactgtatcatcagaaaactgaaaagagtaaacagaaaaactgttagaaataaaaagataattcagtcaagtaatgggtataaaatatatagaagttattgggctacagacaaacacaaaccacttagagcaggtaaaagaagagaagagtccatttgtgatagaatacaaagacaacaagaaatgaaaacttcaagccaagtgacaaaatattatacctcaacttctcacttgggaaatgaattataaagtatgtctcagcttggcatggaaaagaagataggcaatcagctcattatggaagtattgtaggcttcaaacaattttcatattcatatccctttaaatttttctatcaaaaatgactgaaacaaatgccacacaggtcaacctgctaatatttgtcctgaatctcatccttcagttaccactatataaaatttcagtacatccagtgtaaccctgattaacagctacatggaatgcagtggttcctagagtaccgtatgatggtcactggcagccaaaattcctactcaggtttgtaatatgactatgcttttgacatgagtaatttccttgtattaaataaaagtaccagatctgcttattgatagcttttcaaatgtaagcattggtctttccataaactctgctgagattttatgtcagcaagggttggtggcttttgcttttaaaagcacactaatcctgccttctttgaggctaacagctcattatgaggctgtatattcttttgtatctttcaacattgatagtataccaccatagtgctgtgaatactacaggtggccagtaattgtttgaataccttctggctcacacaactgaataacaatttaacttttaagtggttaagtacattcttttaggtttatattatgtacttttaaaagtcctatgcgatttaatctatttctgtatgaaataatgttctacataagcagatctttaagcaaacctaatgtacttaattcatacttttattcttacacttatccctgtgcattataaccattggcttatgtttctggccgcccctaccagcttgggagctactcatgggcggagaccatttcttcttaatctctgcatccccctagtgcctgacgcatgagaacattcaatatttggtagatgaaaacacaaagtgcctagggagataaagatgtgtgtaggatccttcatattcagaaaatccacatagaaaggataagttatttcttttctgaattcatgccaatagatcataatataggccaattcctgtctcgaagtaaaaacccctaccagagaatgagcactcctctccaggccagttccattttgccaagatctgtgagactaagggggataaatacattctaagaagttcttctaatgatgtaccctcaaacttgacctgtcacacaattatcattattacctttaggaattcagaaatgaactgctccaaattccttgaatttcaagaatttctccaagtacaaatgggtgagaagagattacaggacttacacaaaaactgtccgtactttctcattgccaatattttaaaaacaagccatgacaaatatggaaaaggcttattttataggacaaacacagtgctcatctataaaaacattttttaataaggaacacatctcttgtaaaagcagttagaattctgtaaggattattatttattctttacttgatattccaaaatgctagaactactgttaaataaattcctcccatgtgcttctcaaattccaaactaaacaagtgaatgttctcaagccctggaatctgtcactttccaaaagaatacacatttcaaccattaccaaattgcaaaagcctttcacgtgagtagcacagaccttgaaatgagggtgccagcttgaaatgggcacttctccagtgaggaggtagggcacagactggcatgcagccaactgcctgagaggaatgaacaatctgagagagaggccacagctatgggaccctgctgtggccagcctatttctggcattaaagctggtgcttatgcaagactgaactgtgagaacaggtagtcgaccacccacactgcaggaaaatgtgcaaacctttacaaagaaccatcacaaatactgaatatttataatgcttagaacaaatcaataaactgaagtactgcaggctgtttttccttctgattatggatggagtggaggtgggagaatggaaagcccaagtgtgtctttaacaaaatgtagagtctttcacttcaaactcattgtttccatttttgtttgataaatggccaactgaatttactaccattgacagagtaattatctttattttagaagtaaataccctcagtgaaaagcaatctgatgttagctgatctagtgcatacacctgaatgagagtagcaaacattttcttaacaggatcatctaagtctagtcaatgtaaagaattttcaaacaatgtctatataatgaataactacttcaagtgatcaaaggaaatctctggctatgaaaactcaaattttctagagctttaaatcagcttgcattatagtaaacaattatatcacattggcagaagaattgcagcttaacatcaaaacacatggtttagtaattaaaaaaaatttaaattaaggttgagtttaacaataagtgtgtttttagagtctgatatttttcttcatgctgttaaaaaaaatccataccaaataacattatctaaggcaagcagttgacattgctatcttttaacagtgctacttcacttacttgttgcttgatcctggggttccatctaatgtagtaattcacccagagttccaagtgacgcatactggcaactggatataaaactcgattgatttctttagtatagaaggggtttttgaatttttctttattactgtttatcagtgaccataaagaaacagtcctttctgtaaccttctacagagagacagagagagaaagtggagagcctaagtaaaaacacacataaatccacaaaccattttgcagcctgtagcaatacagttcagcatcaaattgaatcacacatttacattatcctcataatagctcaaaaagcctcatgggccagtgagtgcttggcagccacttatcgatatttgcataggtaatggcctagcttgagagccactatttctgcctgaagacaggggcgcaggatactgtaccattaaatgcaattcactgaccaaagaagagtattcccagctaggtaaaacatttatgaacagatgggtggtatactctttttaattcagtgaaaagaaaaattatcctaagatcccaatgacttttaaaacttttccatttgttggaactatgaaatcttaatctgtgtctacttgacagtaggcatctggacacagttattttaatcaaccatccagatgtttaatctacatcatgtcaacatccatatctttgaaaacatctggataactgactacacgaagtctaagcttttcagcctagtgttgccatctcataaagatattcacattttcattgctttttattgcaggcgtttacaaaattttgaccataaactagagagaggaagaaaaaaaaaaaacatcaaagctagggaaataaaaatacaagaattaaaattaccaaaggtagaatctgaaacttttcctagtaatgactttaataagaaaagagcaataagctaaaactggaaaccaaaaagaacatcccaaaataagtgactaaagaaatttcgtggccgggtgtggtggctcacgcctgtaattgcagcactttgggaggctgaggcaggcggatcacctgaggtcaggagtttgagaccagcctggccaacatggtgaagccccgtctctaccaaaaatacaaaaattagctgggagtggtggcaggcgcctgtagtcccagctacttgggaggctgaggcaggagaattgcttgaacctggggggcagaggttgcagtgagccgtgatcgcgccacagcactccagcctgggtgacaagagcgaaactccatctcaaaagaaaaataaaagaaatgtcttaaacatatgtatttcatttcatgaataacgacagcataattttgcctttctctgaatccacctaaaacctcagttgtacctttttgatgccaaaatctatataccacattgtatttatttgcatgttactctttttatttttatatatgcacatagtttaaaaagtcaaatagtttgacaaggttatgaaaaaaagtgctctctctcacctcttttcccagaaacaattgtgtttttcccccagtattatttacaactgacaaataaaaactgtatatatttaaggtatacgatgtgatattttgatatatgtatacattatgaaataatcacctcaatcaagctaattaacatctgtcacctcatatagttaccaattttttttgcagtgagaacacttgagatctattattttagcaaatttcaaatatacattattattaactataattaccatactgcacattaggtctttagtacttataactgaaggtttgtatcttttgaccactatgttcctctttcccttaccccttccccagcccctggtaactacccttctactctctgttactataggttcaagttttcttagattccacacataagggaaatcatgtggtatttgtctttctgtgcctggtttatttcgcttagcataatgtcctccagatttacttatgttgttgcaaatggtaggatttcattttttatggctgagtagtagtctactgtatataggtactacgttttctttattcatctgttgatggacacaggttgagtccatatcttggctactgtgaatactgctgcaatatacatgagattgcagataacctctttgacatgatgatttcatttcctttagatatgtacccaatagtgggagtgctggatcgtatggtagctatatttttacttttgggggaacctctgtcatagtttgaatatttgttctctccaaacctcatgttgaaatctgatcgccaggctgggcgcagtggttcacacctgcaatcccagcactttgggagggtgaggcgggtggatcacttgagctcaggagttcgagaccagcccaggtaacatggcaaaaccccatcactactaaaactacaaaaattagctagctgtggtggtgtgcacctgtggtcccacctactcaggaggctgaggtgggagaatcttgcttaagccaggaaggcagaggttgcagtgagccaagattgtgccactgtactccagcctgggcgacagtgaaaccctgtctcaaacaacaacaacaacaacaaacaaacaaaaaaataaagaaaaagaaatctgatccccaattttggaggtgggacctagtgggaggtgtttgggtcatgaggacaggtccctcatgaacagattaatgctctctcttaggtgtttgttgtcactctatattagttaccaagacagctgagttgttacaaagagcctggcaccctctcccctctctcttgcttcctcttccaccatatgatctctacacactggctccccttcaccttctgccatgagtggaagcagcctgaggctctcaccagaaactaagcagatgccggcactatgctccttgtacagcctgcagaactgtgagctaattaaacctcttttctttgtaagttacccagcctcaggtattcctttatataacacaaaatgcatacctttaatgtaattcctactctttgaggtcaaagacagtgtcttacaagctatcatattttttatatttcatggtagactacatacattttggcaagcctaatgtatcaaaaaaaatagcattttaactcacctgtctttctcgagcagattcacagttgaataagaaagtaccaaatcggcaactatacagatgatccaaaattataatcaaaaattgttcattgaattcaaaagctgtagggaactaaacaaaaacaagcaaacaaagcatgaaaaactgggactgaaactttataaaattagaaagatacactgtagaagtaaacaaatgctgccacattgtagggctctaggaaggacagcagaggctgtaatctgcacacacactacagttgttctttttttagcagtttatataggtctgagcactttaagtgttaaataaagcaataaagaggaaaatgagataaacaggctgattttctgggttctcctgcaggtacagtgtagtttagttatttaagctattatgagatagcagacacagctatatataagggtcagtgtaaaatgtatataaacgacgacttggtattgtcaattccactagtagagacatcagagttaaatacttaatttttaaaactttattagggaaaatcccagatatatcaatagtagcaggaataaaaaggtgaacgctcatgtacctggcttctgcaagtattcacacatgcccagtcttgcttcatctctagctctaccctgtattattttggggtcaaatcccaatcattatattaaaatgtttaatttaaacaatgagttgaatgtattttcatccctcatattccttacctgttttgacatttgccacacacaatcaataaactggagaaaaataggagaacggtcagcatcggtgtggtttttatcaccatgacctattcgctgaataaattgatgaagataatttgttttaattaatgggtacaaaactgagaaagcatataacacaaaatgtgacaatacaattcagcaatgtgccttctaaatgccaagtttctcagagaggaaataatatatacttccatggcaatataggcaatgtaaggtttcaaaataatggaaattaagtatataaatgtctgtaaaataccaataaaaattgccaaagaatcatcatcctaggtgattattacaattatttcatataatcagaattttgtacaagtcctgaacagctatggatagaatgggcatgattatcctacatagtatgttagcaatacactcaacctagttctttcagtcgcgaagaaaacaatcctaaagtttcaagacttaaaatcatgtccaaaaggtatgatgattagaattaaatgttctttctctcttaaaaacaagacaaaaccaaaaaatctcacaatgtattcatttactaaacaatgattctttctatggctgggtgtggtggctcatgcctgtaatcccagcattttgggaggctgaggtgggcggatcacgaggtcaagagtttgagaccagcctggctaacatggtgaaacgccatttctactaaaaatacaaaaaattagctgggcatggtggtgcatgcctgtaatcccagctacttgggaggctgaggcagaagaatcgcttgaacccaagaggtggaggttgtagtgagccgagatcacgccattgcgctccagcttgggcaataagggcgaaactccatctcaaaaacaaacaaacaaacaaacaaacaagcaaaaaaacacaatgattctttctacttgaaaatgttattcacactatgaaacctgggtgaaggctaaaaggatacatagcagtgtttctgaaagggtagcctacagatccccttcatgagaatcactggggagctgggtcaaaatgtatattcagagggcatctggaaataagacctaggaatatgaattttagtatgttcttttgatgatttcattaaaaaaattttcttgggggggttattttaaaaaatttttatttatttttaattgagagagaaatttatatatattgactgtctgtttaatgtgtagcatacacattacctcatagttaccatttttgtggtaagaaaactttacatccattcttttaacattgttcaaaaatatattaactacagtcatcatgttatacaatagctcttttgaacttattcatctctcgatgatttttaaaatgcatatcagaaataaaaagcctcaactaaaagtctataaaatatatttgactctaatagctatattatttgagaaagaattgtctgtcttccttctcttatgaaatttcaatgtaaacatttctatgaagattctttgtattgctttcaagtgaaactgcaaacagtgcagatggataaacatatctcttaaaaagactttcactacccaaggcatcatgcattttcaaacgcgtaaagtttttattacactcctcagattttcattgtaatactgaatatgtaatttaacaactagttttaaaatcctgaatggtagtgatctatttttagaaattagctttgtttactcacagatgcaaatttatgtccaaaacttatccattctttttgtaccagtatttcgaacccttcaatgctcctatagaagctatccaacatcagcatggccaaggatgtcagctgagcagtcctgtcccatccgtcactgcaatgcacaagcactgaactcttccctgaagaaactttgtctgctacttgaatggctcctgtcaaaacgagctgacaaagaaaaatacgtgagtcagtagggagttataagatactgcttacatttgatagtttttaaacttagaaaaagccatgctttaaaatattaacgtccagaacaaagatttatcaaaaggaaacactaagagctgcaggatctgttgatcgtcctctacagacgctgcatttgttttcttttcttcttttttttttaaattatactttaagttctagggtgcatgtacacaacgtgcaggtttgttacatatgtatacatgtgccatgttggtgtgctgcacccattaactcgtcatttagcattaggtatatctcctaatgctatccctccccccaccccacaacaggccctggtgtgtgatgttccccttcctgtgtccaaatgttctcattgttcaattcccacctatgagtgagaacatgcggtgtttgggttttttgtccttgcgacagtttgctgagaatgatggtttccagcttcatccatgtccctacaaaggacatgaactcatcctgttttatggctgcatagtattccatggtgtatatgtgccacatttccttaatccagtctatcattgatggacatttgggttggtttcaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcttatttctccacatcctctccagcacctgttgtttcctgactttttaatgatcgccattctaactggtgtgagatggtatctcattgtggttttgatttgcatttctctgatggccagtgatgatgagcagtttttcatgtgtctgctggctgcgtaaatgtcttcttttgagaagtgtctcttcatatccttcgcccacatgttgatggggttgtttttttcttgtaaatttgtttgagttctttgtagattctggatatagccctttgtcagatgggtagattgcaaaaattttctcccattctgtaggttgcctgttcactctgatgatagttacttttgctgcagacactgcatttgaatgtgcccaggtgttaaaaaacaaactgaaacaaaccaaaagccaaactgcatctcaaacttattttcatggatgtgattgcgatagtgtgctagggctgtcataaagtaccagaaactatgaggcttaaacaacaaaaatatattgtctcacagttctggaggctagaagtttgagatcacagtgctggcagtgccatgctcaccactaaagatcttttccaggtcactcttctagcctctggtcgttccttggcttggggcagccaatcttcacatggcagtctcactgtgtgtgtgtgtctgtgtccaaatttctttttataagggcactagtcataacaaagtaagagcccacactactccagtacagtttcatttcaactaaacatgtctgcaaagaccttcttttcaaatagggtcacgctctgaggtacagggggtcaggacttcaacatataaatttttgcaggacaaaaattcaatccataactgtgatcagattaaaaaaaaaatcactgacccaacaggtcgcgtctagactgtaaaagtctgatacagtgaaatccaccttttgacctttaaattggcaatatatcaactcttatctggctcataatcagtagggtacttaaagtgaaagtattctagtaaaaatttgagacttagaagtatcaataaatttatgtatataacaagttattgctatgatgtcattttttgatgattcatgcatttacagaaacatactttataaacaatggaatatacccatcctgagtgtgagtgcaataagatttagcaaatttatacagttgtgcaattatcaccataatgtagttgtagaacacctgcatcacccaaaaagtttacttgtgccatctaaggtcaatctttctcccaccttgagccccaggcaactactgatttgcttcctgtctctatagtttgcctttactagaaattttacataaataggataatgcaataggtggccttttgtgattggcttctttcacttagcatcatgttttcaaggttcatttgtgttgtagcacgaatcagtacttcattccttctcatggtcacataaccttccattgtatatagatagaccacgttatttatccattcatcaactgatagacatttggttgtttctagcatttggttactatgaatagtgctggcatgaacttttgcatacacattttttgaagggacacagtgtttttatttctctcgggtaaaatatcttggagtgaaacggttggatcaaatggtgaatatatgtttaatttttttttttttttttttgagacagagtctcgctctttcgcccaggctggagtgcagtggcgggatctcagctcactacaagctccgcctcctgggttcacaccattctcctgcctcagcctcccgagtagctgggactacaggcacccgccaccacgcccagctaatttttgtattttttagtagagatggggtttcatcgtgttagccaggatggtctcgatctcctgacctcgtgatcctcccgcctcggcctcccaaagtgctgggattacacgtgtgagccactgtgcctggccatatgtttaattttttaaagaaactgccaaactattttcaaaagtggttgtaccatttcacattcccagaaacaatgtatgagagttccatcttttcacatgcgtatcaacaatttgtatatattatgtaattttgggttggtttttaaaagatttcttccacggagcttccaaattctaacagccatgcaacagacatgtattatagtcattttacccaattcaaggaaatggaaattcgcttattttaactaattcacagaaaaggcagaccaagtgaaagatctgatgtattagggttgaaaaattacctactggataccatgctcactattcgggtgatgggtaaactagaagcccaaaccttactatgcaatatctatgtgacatacctgtacatttaccccttgaatctacaaaaataaaaataaagaaatgtaacttcattagttttacatatacaatgtaactaaagataagtggataaagtagtgccaagaaggaaaggttaagggacctaaggatgtacatcaattagttgtacaaaatccattactcctaaaatgactagagccgtttatttcttcaagcattttaagtattctccttgaaatcctgtttacaattttcatttgaagtacttctgaagaaagggctgttgagaagcaatggtaatatactagatcacttgagtccaatttaatgaagttggggttctaatgcatttttacagagggcaactctcactcgagatacttccctcacttataatataaaaaggactcaatctcagccaattattttcaaaaatgttagctgtgttccaattaagtattaattcccacgatcacttctgacagaaacagctataattatctaataaaactataccagagttttaaaaacacttaaataatctgatggacttgtgactgatgaaagaaatgacagccatcaagcagtatacatcacggtagttaagagcactggctctatggcagaagacctgggcctgaaacctcattccacttttgatatctcgtgctttgggccaattgagtaaccatggtttctctctctctactgtgaagaaatgagccatgtccccactagcttgtcttggactaaaagatgctccccataaagtgctcacattgagcataggctcaatgagggctagctgccatccaagaaggccaaaacaatatgatactttaaaagaagcaggactataggggaagagtattgtattgaaaaggacaaagaggaaatacaagctccagacactacagagtccttcttccaccctgctggggctgtcagtgaactggaatgatgatttgagaggcatgctaaggatggtgattttctcattgcaaaaggcttgccccgctttcatacattgaatggtgacaccatttcaccagattacaggttagtgatggccatgccacctgtcagcagacccagggctataagatagtatagaaggctgaataatggtcaccaaagatgtccacgtcctaatccctggaacctgtgtatactacctcacatggtaatagggactttgcagatgtgatcaacttagtgattttgagaagacagattattccggattatccaggtgggccctaaattacatcacacaaatcctgataagagagaggcagagggagatttcatacagacagaagaggggaaggcaatgtgaccacagaggcagaggatggaatgatatgcctacaagaagctggaagaggcggggaatggatttcccctcgttccaaccagtattcaaggtccaactcaaggctatccacaactctgcttcactgtctgaattgctatgatgtgactgatgcctgagaagccctgagtcagatatcattacaagtgtccacctagactccccagtctcctggtaactcctttggcttctgtacagaacaatgacagtttctttcatttctttcatatcccctttgctatagacaaaactataaaaccttagagaggtctcttaaaacatttcccacattccttaagtgctaacttccatacttcatcttttgcagatggccttacctcctaacttcctcagacatctgagccattgaacaagacctactctcacccagtctctcttccttctatctagctcagagtagcagctgagccaccttgccaataactcctgtacctgtgctctctcttttaaaaaaaagcttttcttcttatttagaaaatatatattccctggaaaaaaatggagaaaacatagccctattactcagaaataataattattcacatattggtggatacctttctaaattctgtatgtatgtgtgtgtgtgtgtgtgtgtgtgtgtgtgtgtgtgtatatatatatacacacacacacgtatatatatgtatatatatgtatatatatatgtatatatatataacttttcttgtacatttaggttctttccaatgcttttccactttttttttaaagagatggggccttgttctgtcacccaggctggaatgcagtggtacaatcatattaataggtcactgcagcctgaaaattcctgggctcaaacaatcttcctgcctctgcctcctgagtagctgggactacagttgtgcacaactacaactattttttgtctttttgtttgtttgtctgagttttttgtaagaagcagggtctcactacgttgcccagggtggtctcaaactcctgggctcaagcgatcctcccactttgacctcccaaagcactgggactacaggcatgagccaccatgctggctctgtttttccactatcataagcattctagtatattcatattttcagacctgtgtgattatttcccttaaaaaaattcctgaagtaaatcttttctctttgtctacaaaacaggctgaagcttcccatgacttgaaaagcccttctcatagtcatatgatcctcaacacttcccccttccttaactctctctcttattaaaagaacagttgatattcattacctctattttctcactcacacccaccacatcactagacacccccaaggtcataaaggacctcgctaataaacctccttcaagtaccactgaccctttcttcttaagaccctttctttaccttccaatatcctcctttgatgtccatttctctggtatgcctccttcactgagctccacttctcacctcctgccctgaatacaaacaggcccaaagctccactcaaagtcctctgatcttttccccacacatcctctctcagaatctacattaaagggctttgcttgcgtttgttgcccaatagctgactgccaaaccaacatctctgtgttaagtctctattttgggttctactttgcagaaagcctgcctgctagacaccaccaggtggacggcccatcactaccccaaatgcatggtgtttctcttgaccaaggtcccaatcaaatcttatttttattttgcctttcatttttttatgaatttgtcatcctcaccaatgaattgttaaaaaaaaaaaaaaaaaaaacaacctaattgtgacaactaaatataatgtgatacctggatgggatccttaaacagaaaaaggacattaggtaaaagctaaggaaatccaaataaagtatgaactttattaataataagttaataatgtataaatattggctcattagttgtgactagtatactgtacaatgtgacatgccatagttatgagcagtgtaagacgtcaataagaagaaaaactcggttgggtatatgggaactttctatagcacttttacaatttttctgtaaattgaaaactattgtaaaataaaaagttttattttggtttttatgttagaccttgtgaatgggaaaatggtataagactttaaggaggttcacatatgattgaagagatgataggtatgtgtaaaaagagacataatgtatagcaaagtcagtggaaggaacattccctttgagattcggtgggatttgatctggtccttgaagaaagtggaaggatgggggaatccattctagagaaagaggacaacctagacaaaggcccagaaacaggcataagtgagatggaattaggaagagtaaggatttctgtagttgcaggttaatctacaaacctgcagaagccagatgaacaggggtgtggctgtcaggttaggctgttgggagcccccagaggttttggaatagcaggatattttaggaaaatgttctgtcagctgcttatagaatagatacgagagggaaggaagagaaaacagaaccattttaagagtgcaaagataggggtagtaatggcctagtttgaatgctgccagtgtgggggtgaggggactatgagagtgacagacatgtttccaaggaagggcctgtggtacttgatgattagctcagtgcaggagctaaagaaatgtaggatgacaccaagagggtgagcctcgctagctgagaagagcatgccaccacttgcagatgaagggtaagttggaaaacaaaatttgactagagaatatatcttaataattcacctatacattaaagctgactttttgtttgtgtacagaactaaatggtttctaaaagtgttagttccctcagatcacttcaagtactttttaaaaagtggaggattattgctgcctttatcaggataaaggattgaacataataaaacacaaaaccaattctttaaaataagtcatttgagattagtttcaaaaaacaaaaaaaaacaaaaaacaacaaaaaaaacaaaactaaccacctcttatctaggtccaaagaggtcatatccagtaatggttagataataaattggctattcctaaataaacctgcatgaaagactgaacgacttaatactgaaagatggaaagagatgtctttgcaaactctaaatatattctggagtgatgatgtgaaatctttaatttaggtaagcaaattataaagcaacataaaactgttaaatgtggtcctctactacaaagtttatctctcaatgtccatttttttaaggaatttaaaaatatgtccattccactaaacaattacattcttttttatatacacaaatattttcacaaaatatacttgccttgatatgttctaaccaatgagtagactccaaactggacaaccaatgagattcttctacattaggataaacaatgtccttcactttttttaaagattcccgcataacatgaatattatgaatgtctaagaagaaaagttcggcgttatgatatgcatcatcactttcatatcctcctcctgttgcctaagaaacaacatgaaatacaaacaatcagttgagttttctatttcatcagaaacttacacaaatatttctagttatttgtcctccaaataaccccaaaccctccaatttaaatgaataattgatgtgacttgacttcctagccaacaacaagtctcaaaaacattagtcatactttgagttgaaaaaaagacagaaggctggcaatttcctggggaatctgtattcctaaggaaaaaaatcatcctcaaaatgctctataattaatagctcttcttccggatctggaaaggcaaaagcaggttgtgaaaggtcctcgttctccattagttttgtatctctaatagtactcttcagggggaaggcgggaggcagccagactgaggcagcagcaggcacctctggcactgtaacagcactcacgtaggacgtgatgcattagaggaaaacaacaggctttggagacagacccaggctgagatagctcagcttcagcttctccttgccatgtgatctgggacaaggcacttaacatttctgagcctcaacatcctctcctgtaaaataggggataatattacctaggtctcatactattaaaggaaccacactctattataatagctaatgccagccactgtttaatgaactcctatgacatcccaggtactgtgactcttgctttacataattttctctcttcagcagtgctgcaagataggtattactgtccccattttgccaatgagaaaacagaaactcagagacgctagttaactatcccctaagtcacataggtaataagtggaatttaagtctaagtctggcttcaaagctcgaactttttctactaaaccatgactatttctctgctatgcaaacaccaatgagagagcactgcacatagtgagctctgaaagaatagaagatttcaagaggagacaagatggctaccgcctactgcagcaactacaagtattaacttgccagggcaggctttggttcatcttcacagcatggtgaagagtgcccattttccacactgacaaaaagagatgctatggtttcatttaggaatctggctgcattctgcttaaacgttttgaaatggcatagaacacgtggcctttggccctttaagaaaaagttaaacagttctgagacttgcaaagaaaacaatattatactaactccagagtgcctgtaggaacagaacagggaaacatctgcctggggctgaagaggaaaggagaagtcaccagacaaatgtgccatagctacaatatgcctattttctctttattaacaacaatggaaggaatataagcttgtagccatggatagaagggccaaagaaacttaggtttttttttgttttttgtttttgttttttcctggaggtagtcacagaaaaaggtttcctgcagaagtaaggctaccatccatttaggtttcaaacttggagacctatgttaaaagccagagatcttggtctctaaagactctaggcaagaaaatatagttaggcagaaatatttctttagagcgtgctctaaatagtatcactggtaagtagacagtaaacattcacagtgttgttttaaaaaagttattagctaataaataagcaatttattatttaagtgggccactttctcctcttcctgcttctctacacatgtggtttttaaatagttatggtgattttcaaagagattcttgaaactagagttctcttcataaataactgaaaataagtgaaaaaataaaaggaaaaatatactttattactcatcgctaatgtttctggtaaaaacagacattagcacagttccacattaattcatcacgatgtaccgccacaaaaatagaagcggcttgctgctagatcttaccaatccttggattttgtttaatttaaaatgatgtgccgttgcttgttgcatctggggatgtaaatttctaaatatccgtaagggaggaacaattaggtccaaggagaacagaaggtcagaaagggcaacaatcaattagtcaagcacacactgagttcctgaaagttcaaattctacatctctggttacttttgaagtattctttttggttttcctttcttcaacaaaaaagaacaatgtagattacctaggacgatgatgtaaaggtctacgggcctgttgctatggatattagcgactagcggagagacacagcagaggaagggagaaacaagtgagctttttaaaagaatgacagagatctgtaaagcttaggctttttccctgatattttccttccctcgactcctaagaggactagaaatagaagcttgtttcctgagtgttaaaaaggccttcaggaattctgttgctggaatgagctttaattagtgtatccatttcatgcattttaatattctaaaatattctttgtaaatacttcattgtaatgctatatcatatctatttcaggctaaatatgtacatgaaaatattgctatatatatatatatatatatatatattcaccctgaaatatatatgaaagataataggtacacagatatataaaattaaggacaatccaagaagatatttagagttagatttaatttcctgagtgtttcacttacgattcctaatttacttgtcaatttaacttactgactgcttcacatataatttcaaaatcatctctggaccaaaaaacaaccgtagtaacaaatagctggtttaaaagcatgcatggggatggggaggtggcccaggattaaatgtgtaggacagaagatctgtgcacaaataatgaagagttgagctctgcatgcatgcagtctgacacatcctagtccagacagatatcacagattctattaggaagctgctgcacctatctgagctgctcaagaacttgttttgctttctggttcttgtcttatgttctgaataattgaagatgctagacaaataacctcaggataagcaatgtattaaatatgatgaaatttaagcttacagcagaggagaaacaataaatctgaaagctggaatgggagtgagcaatttggggcaggcccctcgtgagcatttgaaagtgacagcaatgatgggaggagaaggaaaagaaaaacaacaaaaaggagaaatagaacgtaaaatgcacatcaatctggggccatttagtagagcaagcaaacagccatacaccttgcagcagcttctgaaggcaacactatgcagtcactgatgttcatgatgaccctaatcaattttaagtgcattcagcatattctgcttacagcaaaaagtcaattgagacagacttctttgaaaacggtcaactttgtgtatatgtttgtgcctggaaaactcacatacgtggacctactcatttcttgaattatcttatgtaaatgagaatacacatatgtgagtatatacgggtatgggggagggagtgtttgagtaagcatgcaaatttagtattttaataattacagcttcccatagcttcttacagatgccccaatagtgtacacaatgagtgatcatccacagctgaaagggctttaaagagaatctaactttttcctgccaaggtcctggccaaaacccaatttcattacagtctagacatgcctatttacctaaagtttatttgcatttgattttgatatattcaattttgtttaagttttgtgattaaaactactttctgtctaagagaactggttttcttaactattaatttaaacccacgtgtttctatatcatggcaaaaacattcacagaaaacactgcactccatatgtaagctaagtgtccagcacatcattaagtccactcaccttgttggccactgcatttacgctgggtcttgcatcataaatggtgagtttagaaatttgtttattagtctccctgataacatcgagatatttctcatcatctttatttcgtttcccactcataccgacaagaggctgactgcaacgcacaatgaccgtcttattttctggatgaatccatgacagcacctatggttaagtcagaaagtttaagctatcaagaaagcaaatctccaagcaaacaattaaaactgtaaaacagtaaagcactgacggttatcaagaagtgaatctgattgtgctaaaatagaatacttgttcacttgcaatctcactgcgtgtgtgtgcccagagacatgcatttaataatataactcagaaacaagtacaattaccagtcttttcttaattagcaccacatccaatataaattaattgcttacctaaaaatagttatatcacttaaaggaaattgaaagcttgatcctattttaattatgtagcttgcactggatttgttatcatatagaagcagctttggcaaaaagtgagaggtaaaggaaattgtctctggtacaatatgtttctcataataccaactctgtctacagatcattttcccaacagtctcaattctagaatctaacacaggaaggaagaaaacctgagcagagcaaaactgatctcaggacagcccaaagagcatagatctgctcgtctccacagtgcagtgtggacatccaatgcctaggagacctcatcaagccctgattcagaacctatcttctctaactttatacacaagtctagcacatttgctccctggttgccaagctcatagcatgtgaaaagtaatacacgtaaaaggtagctaataatgtaatataccaaaaacgacagaattgtacacttgagatgggaaattgtttggtatgtgaagtagatctcaataaagctattaaaaatgggaagctggagaactgcagcacagtgggcgacaatgtggactttggggtctagtgccatctctgccgtggttctaacctcaggcatttcactcgcagcttctctggcttccctttcctcttccataaaatggggagaataatataatctcatagggttgctcggtggcctgaagaagaatgcccagaaagtctgcaataaacactggctcgtgttagcttatagaggcaggcccagcagccaggaaagtcagttagcaaaaactacaaaatgcagatacaaagaacgaaagaagcttaatcatgtgggctcactcaacataacaccaaattccctgatgtctctgaagttacctaccccatgatggcaaatgacaaacattgatgtttataaaaatgagtgtttataatgacaacaggttattgagaaaagattatacagtaatatttattcattctcagaacaaatatggtccttgcaccatgctagagatcaattaaaaacaccattgtagcccctgcctaataagagtccaaaggctcagaactgggagccttggagaaggtaccagtgggacctaaacctccaccttccaatctataatgcacagcacatatgagatctgccttcctttccctctatggccctggtatcaagagagacaagagacatgagaccactttaaaggagcaatttgctacacatttaaaagatttattatttgagaaattattaaaatattttttaatattttttattattttaataatttgagaaattattaaaaataaaaattatttattattgagaaagaccctcatcaagttgtaaatttcagtcgggccataggcaatggcctcccgacccctattctctttgtggtgccatgttaggaaatgctactcctctgagttgtttctcctcttaatttctttgcaggaggggggattcttactactttttgaaaaggatgcttattacagagctaaacaggtacaaataatgttcatttcacagtgtcaactaccatgagtgcttttacagtatatggcactgtattattcttattaaaattcatatctagaagccatagataattaagtacacaaatatctaaccactgaaagatgtttattacagcattacttacaatagcaaaagattaagcagaagctgaatgtctcacaatggaaaactgattaaatcatggtacatctacacactggcatatgagcggatcatatttagcaacatgggaagttgtttacaagatattgctagataaagacacaaattatagaataatttctatagactgagacacaaattatagaataatttcacttttttcaaatatatatacatatgtgtgtgtgtgtgtagatatatgcttagaaggaagtctgaaaggatatataccaacagtgttaacactggttctcactaggtggcagactcctttttgcttatcagtattttttataatgcttaaaatgaacgtgcattactcatacattaaagactcataaaattaagagaaatctgtttgagaataagagaatacatatccattaatggaaacatttaatgcacattgattatttctctacccagcaatattttattatagtttatatcttatttacatgcaaaataagatctctttcatgtcacttccttttgtatttttacatgaggttttataaaaagaaccaactatcagatattaatgatttcacattaaaggcacatatgttttctgggtggaagcaaagctctgagacttagccaacagccgggtggttagaaagcatactgcaaagaacatattaccacgcttaatagtacctaatagtaaatctataaatatgtagaggtgatggggaacttagtcttccctataaaagccattttagaaaaaataaatacaaattggtggccatgataaagtaagaaggatcaataacatgactaaataaaaagttaagaaattctatctgctctacagtagacactcattcattcagaataatggggactactggatcaagatggcaaccaagcatggtagaaagggcacagttgttcaattttctctgtttcaaatcccatagaattcacccacatacacaaatgacacggtagatgctcaataaatatgaactgaatgaatacatgaacaaaactgagccaggctaccctagcccagttgtccttgtgagcaaggcatgcattagcaagacagacagccagccagggtaggggtgtagtctgtggctatggtacagaagagcatgtccaaacagagcacaggaagactgaacttgtaaccctagcttcattagcatcatgttctaacaacatgagctaaagaacatactttcaagtacaatttatatcgcgaagatatgaacagacactactaactggagaagcaagtgaattaaaaaaatcattacataaagcatttattaattttaatgggtaaaatagtagtgctatagtggaaaaacatgacagacactgccttagcagaataatcacagttaacatcactaataacgggacaaatcaacagcatgtctcctaaggtggtgcactgagaacacagcatcacttctgcggttttatggctagaagtgtataacaagtgaattaaaaaaaattacaattcatattaggctgacaatacaaaagttttgcacaaatatccttttaaggaaaaaaaatgtctagacttgaaaaaggcaaggtgacattaagtcttaatttcttcaacctttgtttttaaacatttacttattaggggaaaaaaaaaaccccaaggtacttatgacagaccctgaaaattagcaggggagaatacctaaatttttagtcaatttttgtcaatgttagatagtatcacatgtccattaatatttaaggaccaaaagagagctttgtgaactaggtgcagtgataccgtatggatagtgtctggaataatctatacttgactccagttagacaatggtattggggcagcctgcaaaggtgatgggggtgagctcgtggtgagtgtatgtcaaagtctgtgctgacacattttataacaagacagtgtgttctttccagcatgatttatctgacatttatcaagagcctatcatatagtatcatgtactgtgccacaaagacaaaagccacaaagagcctgtctttccttgcttccttccacacagcacttggttcccattacttgcagcccctctctcgtagagagctctttacttgcgttcattcttgatccttagttgcaagctcctagaaggcaggtgacggcacacttcttctccagtctggtatggtactttgtactcacaaagcacttagtaagtattttttgggatagaattccaaaaggaccgtttctctaagttatatgactaccattcttatggactaaaaggtgctcttcaagagaaacgttaattgcagtactcactggaattcgatttcgggacctaaaagttgcaactctccggaggtcatcatctgaggcacgatacggaaccaccaaaagagcagggtaagtgtcacagagctcatagcacttattaataaaagttattctccaatggtgattgggcaagccctgtgaggaaaaaaagaaattcaagtcagtattgcttgacctcatctctggatttggccttgggcctcttttcttccttctagcaatatgtgcacatgcctctttgaccacagggtgatgacggtctacctatttataataagggtgccaaatcaataatccagacaacgtaagaacacaagacaaaacactggtggtttttacagttctaaactatactttgtaaatacagattctcttgaattcaaaggaattcgtcttcctttattttgtgtccacatattctttactacctgtaccacacagataaacccaagttcatcccccgcccatgcacccctcccatcccctaaaaaaataccctgcttcatcttaatctggctctaactgagggtagaaaagagatcaggcaacttcctctccctgctcaaaatagagtgaatgcttcagtctgctccaaagtggaaagaggctgagctcatgaagaaaatcatgaggggaagtaaaggaagatccctctggggaggctcatttcgccacctccgatgagttttttttcaatcaagttgttcggaatcgatgattgccctatagtttgtgtgagaaatacagtcatttgcattttaagcagactgctaatgtgacagggagacacagaagacacctcccatcctatcatctcccccacaaaattgtatttagtatggaaaagatccagaggtggtggaatattctctccccattctcacaaatgcacagatacacacacaaaagtgagctatgtgggtgtttgctttggggacagacattgtaccttttctttaggtctggccctagagaccacggaccaaacagatgttgagtctgatgctgagtccaattagacagttataagtcccatcagaaagttataagaaaaaaagattgaatataatggcagtctagaacaaaataccttcaacagttcatatatgcatgcaatcttaaaaacaggaactgttttgtttcaagctagaagctttgaactaaaaaaaagtcttaatgttatcagtaatacttcaaaaagaaggtaaaaatattttaatacatcatttacagaggtctccaaaacatgcaaaatgttttcatggtccttcttccgcctcagtagctagtccagaactgaggccattaaaatgggagtagtgcaaagccttagaaaactcaacagtctaaacgtgacttatggaagcaacaggatatactatgtcacatatgttctaaagctaaactcctgcacccaaattccagagcgtcaaatctgttcatgaatatgcaaaccgttgattaagactaaaaaaggaaaccaatccaggtttttcatggtgaaggtggtgactagatggttcttctcaagtctagggttctacgattttactttatattcactaccttttcatataaagcaaatgggtttgatctgattctcaaatctcattcaacaaaacttttcaattatcttaagagctttgtagaacaagaattgtgaataatcccatcacacaactcctagctgcctacagatttggttataccagaggtcaaactgtggctcttgttacatattatgcacagaattcccttaacaaaaatactgcaagagacttttgttcctgaacagcaatatgagaccaagcctcttgcctttattatagcaaataaacatgcatgtaggtgacattcatataagagaacagtaaagacaattataatgtacacttatcaaagcttccttgaaaaagacatcactacaggaaaacagttctaattcatttgaatctgcaaactgaaatgaatataatttaaatctaactgcaggtaatagttaagctcccaaacatgcatatacatagcaatatcaagtcctaaagtgtaacttctaaaatgtttgacttttctaaatcctaagtatttaattcatttcataaacaacacagaattgatgctcttcatatagggaaggaaataggatttagtgacccagtcttcgatgcagcttgcatatggcaatggaatgagcttataagttatacagtaatagatagaatgagatatattgtacaaaatgtggataatatcaccaccattgaaaagatatttagcaaggatgtcgctgattttcagaaagcatggctgatgacatactgtcataatgcatgtttcaggttcatcacataccagacaatagcatctaacatcttacctgcctcctgtattcttccactggattgtaaactgtccatccatccacgttaaacttttcttcatttaaaaatgcaaataatggctagaaaaggcaaaaaataaataaagttcagcgtgaaggaacagtctactattatagtacatcttttgatttctcgcaaaataaatttcaccagatttgccgaccatgaaattacaacccacaccaaggcttataacaacaacaacaaaaaaaaacagtggaaaactcagatcagacttacgctaacttctatcttgagtaatagaagcctcaattttctatggctataaatctctcaattgttcttttaatgatgttccacaaaaaaatcagattaccagaccaaaaagtgcctatcaattttaaacagtattagcaattgatcaggtacaagccactaaaaagaaagaaggaaaggaagaaaaataaaattcaggaattattgttaaacggtgcaactgtctcaaaagggaacaatgacatgtttattttttaaaaagataggatattaagaaaactctgagctaactgttctctgtgaattctgaatcaatgccctggtttctgtgaaatggcaggactcagacctctcacctcttctctatatatactcaccctcaacgtgctgttgatacatttgatagcttcaaataccatccatactctagtgactagtaaggacctatcattctccagcatcccctctgaattccagacttggctatccaagtgtccactctaccaccccaccagactgcctaagaggcatctgaagaactctcaagttaacacaaccaaagccaaacactcttggctccccctacccagtcctgctcttcccacagtctccccatttcagtacatgacttccagctgattgagctgaaaaccttggattcatctttgtcaccacgtggctaccacccaggtccaagccaccatcatctcttacttggttgattataaaaacctaactgctcccctgctttcatctttgtacttctcaagtcagagtgacagtgtcataggtcagatcaagtcctttccttgccccaaatcctcccgtagctttccactttgcgaggagtaaaggtggaagtccttccaatggcttatgcagctgtctgccatctggccatctcccccgccacatctctgctctcagactcactcgctccacgtaagtcacacctgcctcctgtgccactccctaaaggcaccaagcacatgccactctcagggcctttgcggctactattccatctgcctggaattcgtttacctcatggcttcttgtcttctctcacatctctgatccaataatcttaatcagtaagaccttctccgacaccctacaaaaaaacatgttaccctcacaacagcactccctattcccatctgattttccctatcacttatgaccatttgacatattacatatgtacttgttcactgtacatatgtactatcccctcccctaggacatgggctccatgaaagtacacacttgcttcattcccatcctttatccccagtaactacaatggcgcctggtcagagggaggcagaacacaggctcgctgaccgaatgaagacatgaaggcccacacagcccctgtacaaccatcttctctggaggcgctgcgtctgggcacttttcctctatgtagctccctccccaaccattttcctctgtcatcagactaatcactttgaacaccagtgttccctcccctacaacacagtgtatttctggaaaagcatctttcagcagcaacagttttctgcatgtgaatggcaagaggtttaaggtgaaaactgcccaagaacatgctctccacaatgtcttctcaaactttcccaggcatgcagcacactctgcaggtctcaactctggcagcgctaggcccaagtgctgtttattctggatggctggcatgataagcacacactggtaatgatgctgacctagctaagcgatgcactgaggctttaacctgacactgaatccacagcaatgcataattattcagtaccactgggaaaaataagtgatttctgttaagtttaaattaaagacagagggactttgggcgaaaatagcactaaaatgtttggtgcactcctttatccataaacagaatatatgggacatgcctaagcattctcttggcaatatatcattactgtgaacatctgatactgcgctggtcagtacttggcacaggtaaacattcaggaatgttgaatgatttgagtgatgtactgttaacatggttgtagatggtttgaggcctaaggctctactgtcactttaaaagaaaacctagaacttgctttcttgaaataagttcctgacctcaacatggtttttgttcatttgttttagttatttgcatctttcccatgaagctcaagtgaatatggcagcttttaaaaaccaaagagaaaaattcctaaattgaaggcccagataaagctttccttccagaaaaaatcatcatgtgtagtaatgctatcagcattaactttcaagcagcattttcaacctaaattactattttttcaatccctaaggttaaagcaccttcttttttttgcttccagtattcctgtatcttacatgaaaatttctaagtttataaaattgttatcagaaaatcaaagctatatggcctaaacaaaaattatctacctaacttccttaatatgttttataaaagaacctgaacagaagcaacatcaatttttttttgtcattagtatgagactgagacaatgtccccatggtaaccacacatcagatggactctctgatgagatcacttctatgatgatacttcacattctgactaatatccagaatgagtcaactaactggtatcctttaacccgaaacatgtctattagaattggtgacaaaaacaactcccagtttactcttgatgctaagagccaggcttggaccccagatatttcaggaagaattatgaatcgcacaacagccaaatatttctcctcgtgaagcacatagcaacacatctaatattaaattggagcttagggtagaaaagactgggtgcttaaaccaatattttcaccattcaaataaattagcttacaaacacagaaaaacatttttcaaaaagcattactaggtagtgtttatgtggtgtttttatttaaaaactaagttttccataagctacttggctcaattgaagtgagcagtctgaaagagccaataccaccattttctgaacttgaaagtacgaggacctacttttcagatatattttctttttttcttaaagattaagagaatataggctctcagagtaacataaagttggattattacaaaaacaaaaataaagcaataacaaaacacattcatctgtacctcattatcaaaaagcataaaatcccctacaagtggtaacttgttacaagcctaattaaagctcctatttcaaaattgttaaaacctgaagtgaataggttatacgtcttgaggtttttagctgtcatttactttctcttccagacaatgtattctttaacactttattaatgtgttgacactttcaactattattcttaaatataaccttgggtcaattttgacccttaatttgggaactctaaatcacatggagagagctggctctcaagtattttccactataaccatcaagcgcgtcttgtttgctaaatgggtaatgataaagcttactcaatgaacacgtccaagtactgatttcatcgactatggaaaattcaagaacgattcagtcccaattgagcaaagtcttaggacagagaagatgttttgctgagcatcacctttcagtagatgcttcagcaagtcctacgtggctttcttctagggtgtggtccttatctacggctctgcctcagaattgggggtgaagtgggctgctttttccagaggctaaaccatgccctgtgccctgcctcacccctactgaatcagaatctctagggggtgactttctacctccttggtcctagaagggccatgtgggatgtaccagaactctcaggaatgtagcctaaggattctgtgtggtcaagctgttggggagctactttagtttgttttagattattttgaaataattatagattcacaagaagtaaatcttcagccagcctctccaggtgttaacatcttgtataacttttagcacaatatcaaaatcaggaaactgacagaagatactctcaaatggccaccctcaccttcctcaagtgagcaagtcatgtcttccttaattttgctctatattagtatttgggcatttcatcaattcacaattcactagatccgtactagtcaagagatactgtacatggagactttttttttttaaagcaatcatgtgcattgtttccggattaaaaatagcacaatgtaacatttgaaaaatgttaaaggacaaacttgagatgaaactctctgatttcacaccagggataaaaacagctctgacatagggaatataacttgtcattttaatttagctacatttatcattgtaacttgtgggggtaaagtctctgaaatgacaacagattttagctttcacttaattagccattatttttaaatggcacctatataaagatgcactgatttccttaaaacatctagattggattttttgtttatttaaacagaatctataaatgttaattcttgagtttcctttgaggacggacagctgtctgtcactgtcataggctctctccagctcataatcaggggaataaattgataaactatgaacatttaaaagtgttttcaaatgatgttaacagcacccaatggcacaactgatgaatgtgatttttcaggaagatgactcttaatgacctatgtctccaaatacctaaacttaaaacttcagggaaccacttactaactgcttctttttgtttttgagacagagtcctggctctatcgcccacgctggagtgcagtggtgccatcttggctcactgcaacctccgcctcctgggttcaagcaattctcgtgcctcagcctccagagtagctgggactacaggcacacatcaccacgcccagctaatttttttttgtattttagtagacacagggtttcaccatgttgcccaggctggccttgaactcctgagctcaggcaatctacccaccttggcctttcaaagtgcttggcttacaggcgtgagccacggcatctggcccaactgcttctttctggattaaattttgcaacgtttgaacaggaattgaagctagctttttttttttttgaatttgatttctgaaattaaagacactcatctttttaaaaagcttccatctaccatttaagggtacagtaatgtaaaattacctcattttcatcttttaaactttagaaacaagacttgatcatgtaagaaaaaaatgctttcattaaaattggaggggaaagcctaaaattttaaagaaccataggacgtactgatatgtggtaaagtttataattctaatgccctaatgctagataatgctttctgtatatttcacacgacttgacacagtaagttcatttatatcagttttgacgcagttattccaaaaacctgacaaaagataacaggtcaaaagcagctagcacatagattaccaattatacttctgtttgcataaacagttctcctaatcctatttctactactgactaaatcagtacctctgggggaaatggcttgatattcctgtgtcatcattgtcttcatatataaacgtacctatttatttgttcacgaaaggaccacaaatgtacatttgaaatgtcatttgaaactattttggaaaaaagaatattctttacaacttgtccactatcataatcatttaaggctgagatttctgagggttcatacattgtccctcttctcactgtagttctctctcctggcaattttggccacatctatgaaaatgctagtgatgtgatgtggatgtgatccaggagtaccaaataaagctctccccaggccagagctctggatctatgtggtcatctgtctcctaggtatctctgcctggctgtctcacagacactctcaactcaacataaccaaaatggaacttgccacctcttcctcactcccctcctatgttccccatctcaaccactggccccaccatcggtctggttatccagggtggattcttccctatcatcccatcctccctcataactacattcagtcaaccaccaaattctactgattttaccatctgaatctttctcaaaagcatcatctggagtccctgtccattgccccacttcaagccctcatcatcaaggactggggtgactagcaaaaatccccagaaatggtcttcctctctcctccactcccgtcccctccacctactctgcacacactgcagcccagcaatctttttgaaatggaaatttaatcatgccacgttcctgcttaaaaccattaaatggctcccttcaccttcagataaaaagcagacattctgagtggggaatgttaggctctgcaatctttgacccagcctcctctgcccccagcactatctcctgttggtacccccacatgcacgctgtgctcccggacaccaaactgcatgtgagttcagcctgcatctgtgcggcctctttgcatgcccacagactgttccttcagtatgacatgtcaatttctgcctgacaaatgctcctactcatcttgcagaatctgaatcctctaggaagccctcctttgtgctcctgtgacatcctgtgcaccactgtatcatatgcatctgtttgtttgcattacccaggaaaacagcactccttgggaacaggaagtgggtatcagctctagatccctgagcacagccataatgtagcattctgtaattgcttaagcaacaatagaaaggaaaagaaaaagaagaggaacaaggggaggctcgttctaccatacagtgcaacatcttatacagcttcaatagttaaaagagcacacctggtgcatgaatagaataattaatgcaacgagaacctcttagaaataaaatcaaacatgcagaggaatttagtgtgagataaggacagtacttcaaatcagcaaactagtcaacaaatgatattgcaacaagaggggaagaaagagttggattcatatcttatactttaactccaaataaattccaaatagatgaaatacttaaatcttaaggaagaaaccaaattactagaggaatatgagataatttattttatttgtttttttttttttttttttttttttggagatggagtctcactcattctgtcgccccggctggagtgcagtggagcaatctcggctcactacaaattctgcctcccaggttcaagcaattctcgtgcctcagcctcgtgagtagctggaattataggcatgtgccaccacacccagctaatttttgtatttttagtagagacagggtttcaccatgttggccaggctggtctcgaatccctgacctcaggtgatctgcctgcctcgacttcccaaagtgctgggattgcaaggcgtgactcaccacgcctggctgagataattccttagaagtctgagtagggaagatcttcctaattgggatagaaagctcagaagctataaaagaaaagtgtgcagaagaattaacatggcaggcctgaggctgccctccttagaaaggcctgcatacatggttggcccttgccagacacttggtaatctggatttcagcagagttctcaccattccctcactggtaagattggttcactgtgcccaaactgtttgtataaacaatgtggtttacactgaactcctgcttttcttctggaagcctggaattttgcttgtgctaggcagtgggtgcttacatggccagccccaataaacactgtggacacaaagtctccaatgaacttcccaggtgggcaacatctcatatgtgctgcacaactcattgctggaggaattaagtgcatcctgtttgattccactggacaagaactctggaagcctgtgcctggtttcccccgaatttcaacctatgtgccttttctctttgctggttttgttttgtatccttgtgctgtaataagccatacctgtgagtacaatatgagtccagtgagtcctgttatcgaatcaccacacgtgggggtggttttagagcccctcaacacagactctcaaatgctaccaaataaatagaaaacaagtctccatagcaaaatccatcataaagtcaaaaaacatacaggaaaaatattagtcactcatattaaacatcactatagctattacacaaaaagtacgtacaactaacaagaaaaagaccaaacatccaaacaaaaaataggtagaagatacagagaatggagaaatgcaaatacaaatagctcaaacctaaagatattcaattttactcatacaagataaatgcaaaataaaactggaagctacattttcacctattagattgaaaaagattaaaagatcagaaaacatactgggttgctatggtaagcagaataaagacctcccagccagggctgggcctcatgcctgtaatcccagcatgttgggaggctgaggagggcagatcacctctgaggtcaggggttcaagatcagcctggccaacatggcgaaaccccatctctactaaaaatataaaaattagccgggtgtggtggcccacgctataatctcagctacttgggaggctgaggcacgaaaatcgcttgaacccgggaggcggaggttgcagtgagctgagattgtgccactgcactccagcctgggcaacagagcaagactctgtttaaaaaaataagaagaagaatgtcttcccaaagatgtccatgtcctaatccctcaaacctgtgttacgttaccatatatggcaatgaggaattaaggtagtacatggaatgaagatcatagggtggagaagcacattcactgggcaatgtctattggtggatggaaataggtacatgacagtgtatatagctctctaccattagggttaagggggaaggcatgtgaatcagttaagtgtataggcctaaactatcactgggtggagacacaataaactgaaacctgggttgtctatgaggagggcaatgaggtagctgaagtgtgccgggagggagattttttcctgtatacccttttacagttcctgaattgtcaatcatgaacatatattacctatttacaacttaaattaaaaagtaaatatttattgaataaatgctatttctaaaaagcagaatattctcattgatgtcttggttgctactgattccgattaattcgctctgtttacattagtatattcactcgataaacatttactgaggctctactatgaacaaggtatgaagtggagaaaaaggcaaggaagacacagcctctgtttttaaggagttggaagtcatccaaaggagagagatgaggagggcatatagagaggatagcagcaagtgccacaggtgggagagagaaagtactatgaggcccagagaatgcccagataacttcttgacagatggggcttggagggacgttgttggtatctgaactaccctggaaggataagacaactctggacaagacgacaacaaaaaggcacaaatggcagccaaactcagagaatatatggccactggcgaacatctcagtctacactcaactccactgagtgaagacggataacaaacaacggagagaggtgggccacactgtgaaagagacagaggtctgccttcacactgacagagagggaggaactggttgaagtttgcgggcaagggataggagacagaatggaggtagaaagacctcctaacaatgttccaacagtttagaagagaggagatgaagatatgaattaagtcaggctggggaggcagaatcccctggatttagtacatgctacgaaacaggggccaggtatggtggctcatgcctgtaatcccagcactttagggggcagaggcagtaggatttcttgaagtcaagagtttgaggtcagcctgggcaacacagtgagacaccatctaaaagaaaagaaaaataaattagccaggtgtagagtcatgcacctgcgggctgcggtgagctgtgatcacaccactgcactccaccctgggtgacagagcaagaccctgtctcaaaaaaaaaaaaagaaaacaagaaaaggaagaaatgaaaacctctgatggccttgatttcgaatgttcaaatttgaatgaacaagaggacaatgatatcattaagagtaactgggaacacagaggagtgggtttctggggcatatgagagtcattttaaacagatcttttggtgttgcttgaagttctataacagctacagggaaatataaagccatgctttatatttggaagccatgcttagaaaggcactgttcgtggacatgagtttgcccagggcataattcagagcaaggacagacttttgtagaaaacccatgtctagatggtagaaggatgcagaggagccagaaaagaagtgagaggcagaggacttagatctcagaagctatggggaaagttaggtttcaaaaaaaagagggagaggtgtctgcaaatgtgatggtctttataccataatgggacttctgctgaaaacacctaaaaatgctggatataacagagacttttttactcagaagccaaaaactaactgcaaacaggaatgcagacagcaagaggaacacactggctttcactttcaggccacttccagaactggttttcatggcctcttggggcacaggagatagggcctgaagacctggccaaaccaaaatgaggaaacctcccaagtgctacactcaggggaaggatgcatgggaaaggaccacctggggacttcaagagaaccttcctgtctagattattggtgctaagcaagggaggaaacaaatccctgccaccatcccccactagaaatttgtagtcacaagtcagcccttaagtagtatgtggacgaaactcacaaaacttggatggtcccaaaaacatccaacctgagaatttaattcataagcgtcccaaaccagtcatgcttcaagatgcctggcagaaagaaacacaaatcctctcttggtaaaattgccttcagtcatatgctcagagtattcccacagataaacttccaaggaagaggaatttgcaggcaataatcacaagacacacccacatcagaaacaaagtgccatgagccagcaaacacacacacctgtggtagaaaagtccacaaagacttcgggtattgtaatcatcagatgcatattataaattacatttaatgtgctttcggaagtcaaaaagaggatgagaaatctgagcacagaagaagagattataaataatggccaaacagatctgaaaaacaatcaaatagaacttttataattaaaaaaacataacaatggaaattttagcaaacaaaaactcagatcaggcacagccgaagtagaagataaaactgaagaaattacccagcttacatctcaggagagacaaaggaaagttccatcaatcagcattctttagattttatacatattttataaatatcctcttgtatctactcaatattttaaaagcaccactttgcaaggaaggggtgggatagttgacagtcaaacgatggtgcagttgaaaggcatatggtctaacagactaccaagttttctaacttgtagggtcttcggtcattttcagaagaatcattccactccagtgagcgggctagacgactgattgcaatgagttatggagtgaatggatgcgagcggggaattctacgcttctgaccatagacaacaatgctacaggagaccaggtgaaatgtcagttccagaggacaggcaatagggagaagaaccaagcacatttcaaggctgagagggagaaggtggtggagacagagagatcaacgagaatagaggaccaagtcttagaggaggcaggaaggaaggagacttaaaagcataactagtgtgtcaatttgccaagtttactgttgattcaagaaaaaacagtcctgcccaaaaaggaaacagataactaagacataacttttagtcattaggccacatctaggctaaaagcatgtgtgtgtgtacttcatttcagtgtccctctgaaaatgagttgtttctttttatctattaattccataatcagcccagaaagtaagggtccactaaatttaagcctcgtttaaaattgcaaagcaatttataaaaatttccacatttctgaggcacaaaataaaacatcctatgttggctggacgcagtggctcacacctgtaatcccagcactttgggaggctgaggcgggcggatcacaaggtcaagagattgagaccatcttaacatggtgaaaccccgtctctactaaaaatacaaaaattagtcgggcgtggtggtgagcacctgtagtcccagctactcaggaggctgaggcaggagaagcgcttcaactggggaggcgaaggttgcagtgagccgagatcatgccactgcactccagcctgggtgacagagcaagactccgtctcaaaaaacaaaaacaacaataacaaaaaaatcctatgttaattctccattcataggatcatttatacctgtcattcaaatgatcataaaagatatatacctccataacgcactctactaacttttatgaaaatctttttacaagtaagcacaactggagtagagcaagagaggacatggggtagatatggtagtgtttaagccacacggcagggcttgatgtggttcaccaaagctaggcaaaaagaaataagcagcaaagactatgaaaaccaaaggcggctgtaacaaacacctgcaaatgctgatgagccctgctcacaaaggtgctgctgtctggaagaccttgcttccatcctttgcatgcaatctaatgtactacaccagcagtcctcagaaggctgctggtctccacagcaaaggctgtgcaacccagctgcttctctcctgaaattagagttaccaagagcaagttacctcacctgtgtcttttctgactgacataagaaggtcaaatatctcccaccacacacacgaaaacaaaaatttcgcaactatatgactgctaatcagttcacagaataacagaaatattttgatgcgaaagagcttcatgcagaatgtgaaaggaaagcggcaagtgcaaaaacaaaaacctgaatgagccatgtttccctaaaagcagtaagcctgagcagggtcaaaagatggaaagaaaaacatggaaaaccatttctaaagaattcttttcatacatatcactgccccccgtatctcacccttctaggtcacatgctttctggatattatgctctgactttcaaagagtcttttctcaaggtacaaccaatggtttgttaataagaatactaatctatatatagcatctttctttgaaagagcttaaagtgccccacatgttatcacgattactttattaatagtcttgggcaaaagtgtgctgggtagtcatccttattctctacacctgctgggaaaacggcacactaagaacagaactgacatttattgggtacttactgcgtgccaggcagcgtcgtaagcactttacatttaatcctcacaaaaccccaacggggtagagactgttattatctccattacagatgagaacacagaagcacataaacattatgtgacttccaaggtcaccaagcaggtaagtgactgagctggattcagacatagaccactggactccaatggcacatgcttgttaccacacaccagaaaggctctgcaaacgtgtcccctcacagggtctccccatcagtggctgctatgagcctggcacccaggtctcaggcttcatttcttctagccctagccttcctttgtgtgagtctatatcccacaagtttattcataaactctaaaccttcacttaaaattcaagaaaatccatgtgcgcctactgctataaaggcagatttaagtgactatattcacgcctacaataacttaaagtgcagtttattctacatattctaccattacctaaaatggtgtttttcaaactttttggaccacgattaacggtaagcaatgcacttcaacaccatgacccaatacacacatacaccggagagaaatgtttcacgtagccacacttatccatattatgttatgctcttattctattctattctattttaaaatgctggctgcaacctagtgaattgattttatgactcattaataggttaggattgacagtttaaaaaactctcatctaatatgtgtattatctctgattatcccatctgagtaaaaaatgagcaaacaataaagaaaatcaacaaaagaacaactttgccattgaacttatcaccccaacaatcaaactctttatctttctgtagcactatcaggctctgttcagttatacatgattttaatttctgccttaaaaaaatcgccatactatcagaaacactgacatttattaaaatatatcatttacctagaactagtattgagcttcatgcaatttatgagaattcagtacaatttctagtgtttgaaaagcaaagcaaatagatttttaaaaagaaaataaatgaataaatttctatttttggccaaaatagaaatgttactaaaaaaagtgcgcatcttaccagattgacataacacagaaacaatgaagttaatggtttggggtgaactctgttgctgaacagctcaagttcaattcaaagtgttaagtcgtgacttgaaaacactgagtggtgaaaatactaatgggacaggaggccagagagagccaaaggggtggtctgaaatgaaaaagcccactcatggtgtattcatgacctggccggagtcaggacccagcttgcttggcctccagacaccatttcatagatgcaacagcaagttcacttctgacttcaaatgccaataaaaatcactaagataatctgcagctggctgaacagttccaataatattaacaaagtgatctttttcaagcaggggccctttgtattgttcaaggcaatcaggcttatgttacctcctaggaaagccctttttggcacactcccacattccccactgtgacagtttggaaacttttcttcccctcctgtctcacagaaataatggtcccttctcctttcccaaactgccccacaaactgggctggatcccatccccctctgccttcttcaggatcctgctcaagaaaagatcccttctctctcttgccttgaaaagaggcaagatttctttccacaaatatattcattttcctttttcaaattctaaggtaaaaactttcttccctcaacatgcctgccactcttttttaaaccaactatgcttcctttaaacacctgcaaactggtgtttgtccccgtcaccccgagatcattttctgagatttataaaggctcaaaaagaaaaaaaaccccaaaaaacaaaaacgtatgccaggcactggactaggcactagagttgcaaagataataaaaggaggtcccgactttaagcaggtcagttagggtcaggtccctagggagcttgtgatccatctccccagctctcccagcactgacacccatgacatcctgttaatcctttccaggctcttccctcgcctctgtaaccattccgttttctggctcctttcctatcttcactccctaaaagatggcctctcccaagattctggttcaggacttctctattacataccaggattactttaccagggccctacaaaggggcttcagaggggccagaagtcctctaaaattttaggtaaggttttgtacatgactgcatgtttgaggggaaaagaaactataatttacatcgtattctcaaaggagcccataacttcaaatgacttaagaaccactattccaaatctatatctctagactctttactgaggggcaggccttcagtggcttgctgtcaattctgtcaaaatacatgaaatgctatgtgtccaaaacagaactcattgttcctcccccttcccctttcttccacctgtttctgcaaataaaatctttttctgacttccctactctgtggacagtgccccaccctcatcactcaagccccagacctcagaagtccttcactggaaattaaatccattcttcaaggccctatactaacaactatcaattccatgtaggcctttccaattttggttagatgtggtctcttcttcctgtgagtcccccgtggatttcctttgcgtttctcttgcacaaatgaatgtatactatcttatgttggggctaaacatatttgtcacatcactactgtttgactgtcacatccctcaatgggactaggtatcactcatcctacacactactaaatccttgactgcccccactgcatcctgacaccacccaacacaagacatgaaatgaacttgactgatgaaacagttgcacatgtggacttgaatatcagggactgctattccaaaagcagggtcaagggctgatctgtttcaatctgtatcttgcattgtattggtgactggcaaactttttttaaggatgactttcagtgattaaaacctaagataatgtcaccttccaaaacttcatatgagcaattcagttgacttttttttttttttttttggcagtttcttactttattgacttcctaaaacaagaagcagggattctcagcacaggtatgaaaaatatggccaagtaccacagacttgagaaatcaagccctctgtggatgactccaataacagcaacagagatttctaggttttggtgttagatttgtaatactcagaaacatccatctcatttgtttccatatagtgatttttccttcctttctactaacccgagttcaagaagaaagccatcattacaaaactcccatgcagatgtcactgtgctgacagtagagagagaaataaaggctgatccctgccttgataagctcataatttatcaggcagtggtagggggaggtaggaggtagttatgacaaaattattccataaggcacactgagataagtgctctgatagaggaacttgcaaagactaacaattgagcggtaagatgaactctcactgggggcacacacatatggcctggaaaaggacacaggacagattaagatgttgaaggctaagtgtgtggaagatgggtaagcaagagacgaggggactgcaggtaaaggggacagcaaaatctgaaccaagaaagtactgtgtgtgctagaagagcatagggcagccctgtgcagctgcagtgtagggcacaagctatgaaaagtaactgggggtttgttttttggggggtagaggatgatacagtaacatgatcatatttaaaaacaaaacaaacaacaactggcagcattgtgtaggattagctggaaggggaagaaactgaaagaaaggaagccagtttggaagcatggattaaggtaggaagcataagtagaaaagagaggaaatagctgggtgttgctactaagtagaacttacaggattcagaattgatgtgcctatgggaggaatagcagggggggaactgaaaagctgacttcaagttatcaaacctaaacaactggggatcctcaaacttgcaggacatataggatgaaaggtaggtttcatgaactgcaaagaggtcagggcaacaagaagtttgtgattctactttttttttttttttttttttttgagatggagctttgcttttgtcacccaggctggagtacaatggcacgatctcagctcactgcaacctctgcctcccgggttcaagcgattgtcctgcctcagactcctgagtagctgggattacaggtgcccagcactacacccagctaatatttttatatttttagtaggacagggtttcaccatgttggccaggatggtctcgaactcctgacctcaagtgatccatcctcctcggcctcccaaagtgctgggattacaggcgtgagccactgcgccagatgagctcatgattctcagactcccagaggaaggaatttgagggttagactcattggactcactcaaggacaatatcagggttagatttagaagtcatctacatagcagtgacgactttaaactaaacgaaaccatcaaggcaaagttaataagatgagaagagaagagggatgagagtgaagacatatttacatttaaggaaaagacagaggtagtggagactggaaaggaacaatcaagatggtgcaggaatacagaaaccaagactttcaagaagacgatggtcaaaattgttgaatgctggggaagagatcaaacagaatgagatggaaatgagccactagatttggccagtaatgagctccatactggaatgggttggaggaatgaatgcactggagacgaggataggctagaatattctttccagaagtttggcaatgaagtgaaagatgggacagtagtataaggggaaagctggtccagcacttgacttttttaggggagtataccctagaagaaacagaagataccagagaaaggggatgtctgatgaagcaagatcttgcaggagacagactggggcttcagctccttcaaacctgccattctgtcaatttctgataatttagggccagatatgcataaatcaagacagaacacatttcctaattgaactttcatcaattagactcacattctcactttcataataattaagaagatgtgttcccatcagactctctttttatcctaatagaattaaaaactctaatatagacatatttttaaaaatcacatatttaatcagaaacttagaaaaggctgaaaatagattcaattatgagatcagcacatttgttcccaagcattacattttcatctgcgttcaacacatgcctcttctacttaagggtcccttccatcaccttcggtttagtctgcaatatgatcatcctatacttaagataaaggcatttatacagtatatgttgtaaataattattttttcactctccccttagcaggtatttgcatctaagttcaagtcaaactgaggaggaggactggggttagaagattcaagcaaggcacggcagtaaaaaaggaggcaaggccgaggcaggatataaagaaagattgttctacaagcaaaactcatagaaagccttatttcagtcatgcagtaagagtaaggttactccagtagtttggtgaagaggaaggaaaagttttaggtacatatactgaatcacctttggactaagtcatagattacaactaattaaatgcataataaattggtcctgacaattacataataaatgctatcaaatgacatttgaaaggttattcttttcaaaaataaaactgcccctattcagctattggtgcagtacctacaccacacatctgtatttgttcaaatggcatttaggctcagagagtttgttcccatttacaattggagccacaaaagcctgacactcattgctcattagctccaaagttgactgacaggggagagacctgttccctctggaaatgatgaaattatttaataaacacctctgcagacacatcacactgggaaacacaacacagacattaaaagaaagaggatcccagtttgcaggcagttttcacagaggaggcactgagaaccttcccacgctgaggagagcactggaatttaccagactgtgagccaggggaaacgcgtatctcgtgaggatctcaaacatatctcttctgctgtggccttcctgtttcaaagcgaacctcaggtttctcatgtcctgggggcaaaggagaagtatgacagttcagtcttcaaagaaagtcatgttaattagcaagaaatcttccattcaattaagggagaagattcacttacctaaaagggcaattaatctaaattattacaaaattgctttgttttatatggtaatttggtatatctggcttaagaacacctgaaaatatttccgtcatagccatgaatgtgaagacaagataaagcaactagcactaaggagaagacagagctaaaattcattttataaaaaggaaaaaaaaatcaaaccttgccttgcacaacatctacgatgatccatctactttcactgggttctgaggtatttttaaattttttaaaatttattttatttaatttagtttttgagacatagtctcactctgtggcccaggctggagtgtagtggcatgatctcggctcactgcaacctccacctcctgggttcaagggattctcgtgcctcagcctcctgagtggctgggactacagaacgcaccaccacgcccagctaattttttgtatttttagtagagatggggtttctccatgttggccaggctggtctcgaactcctgacctcaggtgatctgcctgcctcggcctcccaaagtgccaggattacaggtgtcaagccaccacatccggccctgatattttttttaattataaaactattttattcaaacaacttttctaaagagtacctgctatcaaatataatctcaacattgtcaaacatgtcattaaaatacagaagctctcttcctaaatgactgacattttaagccctcatgcaagtcatatatttttattctacaattttaccttcacagagttccatataagccacattaaagtagcccatattagtagtaactacacttttgggaactaaaaataaacagtcaaaaccagattttaaaggtagcttccaatacatatctgttcaataagcaggaaaactttgtcttaaaccaaatccaaaccaaataagctcctttaaatgtcaatttgtattatatatacagatgtaacattctatcttattttcaagactggagttttttaaggttgtatcttaaaaaaaaaagtcaattacagtgctgtgactgagtgatggctctgcattggaaccctatgctctgcagtgcactttaaactttcatttcagataaaggagtgctgtgctggaccatggagccacttcaggagcggtacagacctagttgttgccctcttggatatcacagtcttcattttttttcaaggtgctttttccttccttatctcaagagcactcttaacgcttcccaagtcttcagtctgaaggaccagcacaggctatggccttcacaagacatctcaaacacaaatagcagcaaatgaagtatgaagaactaaagtctgagaccactaataaagaacttgagattgagcactctgtatacagatgacatctactaggccttgccagctccacgattccatgcttttttaaaaagcatgtcacagaataaagtccaacaacccattcatatcacctcccaagaaaattgggctattggttattggtttgtgatgaaatgaacagttaaataaggggaataatcatttcaatgggatgatatgcattacaagggtttacgaccagccacaagtgcaatactggagagctgagcattctcagggctcaggccctgtgaggaactttcttcctaacagccgcaagtcagatggtaactctgtaacatcgttctcttcactgcttggccagaaattagaccatctctacatgaatatttattctgatctatcagtgattcaaacagctacttttaatgtgccaaagcacaagtgattcaagtaacttctttttgccatctgattaagatgcaattaaagacagaatattatttcttgccaacaaaactgaagtagaaaaggcaaatgactcacaggcggcagatcaccaaatctgtaacagaaataggagcacagactaactggtaagttccacctggtctcctcagagtttgactcatcagggaaagatccacatgggctaagagtctcctagtcagaccctcagcctttttaacagccgggtcatatggtgatgttccaagcctcactacagtaagagttgaagaatacatatccctgctgcaacgactctgaagagttgatttattgaggcatcatttctaaagaaacaacacacatgactgctgacttcaaaatgccacactatgtctttaaggcgagtacatgggagtgaggtggggaaggaaagagaaggctttgtggtggtatggttttacttcacttttttttgtttgaaagactccacacaggcaccaggggttggtatggggcctgcagggtaagaatttgcatattcagaactacctttctcctgctgctggacaacatcctctgggacttgtatctaccatgggaaagttgctactggcaagcagaaatctctatgtgcattgctggcatagccaaatttataggagttgtaactacttgtttcaagagagaaatgcggttgtatcatggttattgactgcaggcgaaagttgacctatgagagacaggacagtgagtcttttatctcaccgaagcagatttcctttatatcaatgtcaggtttgttactgagaaaatggaatatgactctgtgacgtcagtgtttctggggagacaatttagttaaaaggttgtgctacaacattgttctaagccatcacctttgggctcatgctaactccaaaaaatatacatatgtaacatttcagaattatgcttggtgagttgttcctacgccttttgttcgtaaatagtcaagggtgaaaatgtgctttgtctcattaattttggggggattgatatttaagtacaagtttttcctattataaggcagaaaataggtttttttaaaccctgtaagaatgaaagtcacctcaaaactgtcaatatagcaaccccattttcccttgagcactctaatattaaacactctactcccataaatccttttatgcaaaatacaaaagtcttccttcaaagtaaattcccatgtttctaggccccaaagggtagacagtagctgggataatagataaagcattaaggtagctcgaattaaaacaccaccaaaaaaaagctgaggtggatggtagtggtgaatttcagttaagatttaataatggcattatcctttagtttctgatagaaaaaacgagtcttgatcttttataaacggaaagaaaaacaccatattgcagcataatccaaatataagcacacaatgttggttttgagaaatcgcagtgtatgagactagaaaaaggagacttagtttttggttctggctcttccgctggctccctaggcaacacaaggcaagtaatctcacacagcaaaggcctcacttctctatcaatacaatgaacgacttggattggccaggggccagcaaacttcagcccaggtcttcaaattaagactgtttttttttttttttaacacttcaaaagggttgaaaaaacaacacacagagaagaatacacaacagaaatctgatgtggcccacaaagcctaaaatatttgctactgagcccttcacagaaaaagtctgcaaagccctgcactggactggtggttcatagtcacacgagacgcttgaacacatccccaccttttgggtcccagccttcagaaattatcttagcaaagttacccaactctttggagcctcgggctcccatcacgccatctcagagggttgcacttgaggatcaaatgcaaagcacctagcatgtgtttggatggacacaaatgttcaatacatggttactatcacagcaaagtgtacctctgaaaatgacctaagcaaaagttacgaaggttattagaggtaaggacacatcccgttaacagagggcaaaatctcttctattcctccttccttcatgttaacatatgacatgaaggggcgccaggagcaagctggagcaaaaactaaagtggtttaagaaattttatctataaagttctcttcccactcagtcaagctaacaaactgaccagttcctcgagtccttgtatttggtgattgcagtgggtccctcacgtgggcactatttcccaggcacttttgaaaagcttgttcttaagggaagaaccatttccagggccttagatgaacatgagattttgatttttttttttcaaatccacattaattgtctactatcattcaacactaacgtgccttgttctttgcataagaaagtatcgaatctcttactttacaagtaatatctagaccataggaattttctcctctacttgtcgcgcctcccattttttcaattctcgagatcacacccagaggaacatcaagtattagagaagaatcctgtaatggacaaaaatacagtagtcagtatttctgtcagtataattaaaacatcaaaaaacatataaaaacaaccatatgctttcagagtgattttaccttggcccttttagcactttatgaacaaaaatatgatacagatcacacatgacagagcaagcattaaaacagtcaattatgcaatcaaaatgcatccccaaacatttgccattgtgcactgcctctggagtaaagactaaactcctaggtacacatttccaggacgtccgtgatatcacttccagcctgtttctgtgggattctctcccacgatattctgcactccaactaagtaaacttcttcattcttcagatgcttcatctacgatcaagccacctgctttgctcagggtgttccctttgcctagaatgatctgtctttcccagctaccaaaattgtccccatgactttcgccttggctcagcaagcatcacctctaatgaggccttgcttcccaattagatcaggcagaattcatcactttttcctcagaagttccatagcacttgattccgactgctgttaaccacttgcttcactctgccttgttaccacgaatttacacatatgtattcccccactagagaccacgcatctggaaatggtgcttgtctctggcatgcgtgcatttcccaaagcagaagggccttaatgcacagcaaggcttctccatcatttgctatccaacgctgggtgcaagtggtctagaagactgctggcatgatggaatcatgttagtcaagtaatagcacaatcatcaccaggagatcatcacagcagctgccatgtaggaaatacctctcttctgtgccaggtactacattaggggctttgcacgcatcatctcattttatcctcacaaccgctccaggatataggtgaagtatccccatttcctaagtttttcaaagcttcaataacttgtttagtaagtatagggcagggttgagactcgaggcaatgcctgaaaacacacattaaaagtgccataaaaattgtcctactctttgatccaataatttcgctactaagaacttatggctatcacttaacagaaggaagatgttcaatggagctagaggtagataacagggtagaaaaaattatagtcaactcgctggaacaagtatacagtttttaaaataattatggtacatggaaaagtaagtttaagtgggaaacagcagcatacaacacacacggtgactacaataacatgaaatatctatttacagggacaaagacatgaagggctacaccatttttaatccaaacttttctttcatattgtgatagataagtttgaaaaataaagaaaaaaaatttttaagggttatttggttttttgttccttaaaaaccttttggggctacaaagtttttcttttctttcccccctttttttttttttttaagagataagttcttgctctgttgctcaggctggagtacagtggctcactgcagccttgacgtcccaggctcaagggatcctcccacctcagccttccaagtagctgagaccacaggcacacaccaccagccacacttaatttttttttttttttagatgagtctcactctgtcacccaggctggagtgcagtggcacgatctcagctcactgcaacctccacctcctgggttcaagcaattctcctgcctcagcctcccaagtagctgggattacaggcatgtgccaccatgcctggctaatttttgtatttttagtagagacggggttttgccatgttggccaggctggtctcaaacccctgacctcaggtaatacacctgcctcggcctcccaaagttctaggattataagcatgagccaccatgcccagccaaattttttaaaagttttttgtagagacagagtcttactatgttgtccaggctggtcgcaaactcctgggctcgagtgatcctcccacatcagcctcctgagtagctgggagtagctgagaccacagatgcatgccaccacgcccaactaattattttgtattttttgtagagatggtgggggggtctcactatgttgtccaggctggtctcaaactcctgggctcaagcaatcctcctgccttggcctctcaaagtattgggattacatgtgtgagccactgctcctggccttttatattaaaatacaatacagaaaataagcagttattcataaaatataaatgcagctcatgggttatctagaaattcaaaaagtgtaaggctgcgagcatccataccatggaataccactcagcaagaaaaatgaatgaactatggatacatggaacctggaagaatcttaagggcatcacgtggaatgaaaatcgccaatctttttttttttttttgagacaggacctcactccatcacccaggctgaagtgcagtggtgtgatctcaacacagcctcaacctccctgggctcaggtagccctctcacctcagcctcccaagtagctgggactacaggtacatgccatcgcacctggctaatttttgtacttttgtagagatggggtttcaccatgtggcccaggctggtctcgaacttctgaggctcaagccatccacctgcctcagcctcccagagtgctgggattacaggcgtgggccaccacacttggctgagaaatgccaatcttaaaaggtaaggtattatatgattccttttatataatgtgcttgaaatgacaaaattgtagagagggaacccagagaagtggttgcagaggttgaggggagggatagcgcgactctaaacgggcagcacgagcgagttcttttgtggtgacagaacagttccatgtcttgattattgatggtggttacctgggatcaaatgctacagaactgtgcacaaaagcacacaaaaagtgagtgcgggaaaaatactgctaaaattcaagtatggtcagtctagttgtgccaatccacttcctggttttgataaagggatatagttattgtggggaactcagtaataggtacaaaggacctcttctatttttgcaagttctatgagctcataattatttcaaaataaaaaagcaaaaaagtgtacgagtataattatcataatgtagagaaaatagtacaagctcttaaggcggacaaaactggctcaatctgaatcctgacatttactagctgataacagtggtgagttactatcactcagtcacatttatctgaaagtagagatgattacagaaaatgagtttaaagtacctggcgtcgtgcctgatgccagtagctagaaaacaatggaagttattattattatggcaaagaatatcttagtatttggaagatgtaattgtgctcttcaaatatagtggatcagtatgctctagcaagcatctaacagatcttactgtttgtacctataaggaggaatgtcacggggtaagacacctcatgacatgactgaaacctaaatgcccaaagagaaaaatactactcagtaacagtgtacgtatataagcagcatattttcatgtatttacttatcgatacagtgcagttatttaaaacacagtatcagtctgttattatgcttagatataccatattgacatttgagtgtctgtgaactgtattcttaaatgtcaaatttatacataaaatacacagaatagacactaaataagtctgatactctagcatcaacatggaagcaaggatgtttgaaaaaagtggaagaattaaaagtgagctaacaccttgctactctttgtctctgtacagaggaaactgtatagctcaaagagccctggccctacacagaaaaaaagaaaacaggtcgctgaggagaaccagccagcttctgaccaaaggcacccaccgtctaataaggttacttgctacattctccctgaatgacacattcaaggtcagataacccagcaggccaaactgcaagatccaggaataggcaaattagctgaactttctggatacctgagtcatcagtatctaaatatcattaaatatttaaggattttcaaaggcccattctaactcaaaagtctatgccttgtacttctaactacctaaagtaattgacatgaaaataggggagttaaataacctaaaataatgcattctttctttctctctctctctctctgtctctgtctctgtctgtctgtctgtctcatacactaagtaacagaaactctactgggccctagggttcatgaagttaagaagcagagttgcccacatggagttcagggcctagctctatctgggagataagacacatggactcaagtaactacaatgccaggttgctagtgccaagagccataggcaaagtccacacaaagtgaaaggggaggtcaaaggagggcaaaccatatctgatgattagatagcatgaaggttctgtggcaatgactgcattaaaaatgatccttaaaggatggatcaagagcaactggagattggcatttgagaagcaagtaagagtcacatcagctgcacatgtgggaaaagcatggagagtttattttaaaaaaatataggccaggtttcagcaacggtgatgggaatttcctggggagtactacacggctaggatcagggagactgagatctaaaggatgcttctggagaacaggaatgccatgattaactggtgctttatgaagattcatctggcagcactgagcattctggactagcaagaagtgggctacaaccactcctcaaaaccatgaaagctgatacttcagtacaagtgagaggctatgaggatctagaagtagagaaggaccgaggtagaaagcaaaagagactagccactggggaagactcaaagatgaatcagctttgggcccagatctctgggataaatagtggtggtaccaccaaaagatgtgaagaacacaggagggggttttagagaaagatgaacacggccgattttagaaactcttggtttgagattatgataaatgaaccaagtacagatacccaggagatggctggatatacagaactgacaagatctcaagggtacctcgaactaaaaatgtccagaactaaatgcagttctctctccaaactacattattctccaaagttccctatctcagtggctggttacgaaagctagaaacctagaagtcacccctggcatccccttctctgctatccttaagccagtctcctatgtctacctcttaaatcagtctcaactctgctaaccactccaattctaccagcaacttctctgggccactgccgtggttgcagtggtctcaaaatctacgatcattccccctagagtagccagggtgatcttttagaagagcacatctgatgttatcattccttggctcacaccactttgaaagtggtgtgaaaagcttcaaaagcttctcattgctgaactctaaaaacccaaatcctgaccaggcatggtggctcacgcctgtaataccagcactttgggaggccgaggtgggtggatcacctgaggtcagttcaagaccagcctggccaacatggtgaaaccccgtctctactaaaaatacaaaaatcagctgggcgtggtggcaggtgcctgtaatcccagctactcgggaggctgaggcaagagaattgcttgaacacgggaggcggaggttgcagtgagccgagatcacaccattgccctctagccgggggacaagagcgagacttcatctcaaaaataataataataataatcatcatcatcatcatcatcatcatcctggggaaggcaatggggagatgttggtcaaaggagacaaaatttcagttaataggaggagtaagttccagagatctactgtacaacaaagtgactacaactaacaactattgtgtactagaaaattgctgagagtaaattctaaatgttctgaccacacaaaatatgtatgtgaggccatgcttatgttaagtagcttgattgactcattctacaatgtgtatgtatttcaaaacacgttgcacacgatatatacaatttttgtcaattaaaaaataaattaaagggctgggcatggtggcttatgcctgcaatcccagcactttgggaggcggaggcaggcggatcgcttgagccaaggagtttgagaccagcctgggcaacacagcaagaccctatctctacaaaaaatacaaaaattagctggccatggtagtgtgcagctatagtcctagctactcaggaagttgaggtgggaggactgcttgagctcaggaggtcatggctgcagtgagctatgattgcaccactgcactccagcctgggcaacagcgagaccctgtctcaaatcaatcaatccaatgaataaatgaaaaaataaaaaccccaaatcctgaacagggtgggcaaggccgaggacatctggccaccatctacctctctcacctcatctcttgccattctcccccaactcagccatactgtcatttttcatgcttcctttggtctcaggtcctctcatatgctgttctctcagcttcttctcacctccccagcccctgactcacatctagggaacttatatgtattcttcagaccccaggtcaagcattttctcaggacaatttcccaggctcctcaaactgttgtgcccctgtactactcccacgcaacactgatcacagcttgttattatatattggcgtgactatcagaagaatgtttatcaatcccatgagaactataagcttcgtgagggagaaactgtttgcggtgctcaccatcatatcctagcacctggcatagtgcttaacacatactggactctcagatactcaatgaatacagaatgaaagattggaactggagctagagaattggaaagcaactgacaatggagaaaaaagagggtgaggacagaactctggggaaaataatatttaggaggtaggaaagaaaaaatgagccgcatagaaggcaagaggcagaaatgagaggagagccaggaatgtatagggaaaaggataaaggaaggagcagtcaacagaatcaatccctgcatagaaatttaaaagtcaagaactcaaccaaggccactggaattgagcagtaaagtagtttcaatagggaacagaagccagaccacaagaagtaaggagtcaatagtacggaagtggaagcagcatgtgtggactaatttttaaagaagtttgtgcaataaggggaagaaagaggatgatagtatcagtggtagcaggaatacaagaaggtgttttcaaataaagatacttgggcaaggctgggtgcagtggctcgcgcctgtaatcccagcactttgggaggcggaggtgggcagattacttgaggtcaggagtccgagaccagcctggccaacataatgaaacaatgtctctactaaaaatacaaaaattaactggctgtggtggtacatgtctgtaatcccagctactcgggaagctgaggcgggagaatctcttgaacccaaggaacccaagaggtggaggttgcggtgagccgagatcacgccactgcactccaacctgggcaacagagctgtctcaaaatggacagctctgtccattttgggaggggaggggagggggaggggagggggaggggagggaagggaagggagggaaccgagggaagggagggaacccagggaagggagggaacccagggaagggagggaaggaagggaagagagggaagggagggaaggaagggaagaaagggaagagagggaagggagggaaggaaggaagggaaggaagttgagcagattcacagagcggggggaaggagaatcaaaaatgatgaaaaccaaaaatgtaagacacagaataaccaatggggaactaagactccagaggagaaaggtgtaaagaatgggattcactttggaaaataagatgtctgattccttcctctcagatgcgagggaaggaggaaaaaatgggtgaaggtagacctccttaggtggtgacaaggggacttttcaacagaacaagagatgaggttagccaaagagcatgaaaggtttgtcactgtagtggtggaaggtgtagtgagaagtcaatctgagaccgaaggaattgccaaagcagcgatgagaccctttctgaaagcctgaacttgtagtggaactaattaattaaacctgttatgtgactttcaacatcagagcttagtagcttacagaccctaaagtttggggattagcatggggacaagggacaaaggaaccaagggtactggcaggaattaggtttttgttttgttttgttttgttttgttttttaatgtgaagaaggcattcattttgcagcagcaatataagaagatgatttaagactggaagtttaaaataatacctatagcatagatcctatgctcccactgatgttccgatttatggacagactagggtgttttattatagtctatttagcattatttcacctaccataaaatgaaaagaggtgccaaatccactagagagaaggacctgaaaaggacagtcttgaaaagtttccaatgcttttttttttttttcttcaaggaaaaaatactacaggaatcctttttggctgtgcttgtaattaagtggactggccttccctctgaaaaagaatataggtctggctttgaaatgctcacactgaaaggtaaactctgcctcccttcctggtagtatccaaggcttacagatccaatgacagccaccaatagagatgaggaaacccgagtactgctgcacttgttccacacccagctcttagatggcacaacacccagcacccatctgaaagccatttcataaccaggtatttgagacagagtttgacagacatgtaaactgcctactcgtcttgattctccaaatattacctttgcactggcaactcatcagaaaaacaaagtaggccacattatatagttcttcacagaagcacttttaccaactaaaagttaacactgtatgctccatctttatagagaatcaacaaaagagccatcaaattgaaaaggattcaagaatctttgggtaatacactgcctgaagaattgaatcactgtgtcactatcttttagagaaaagccaaacaacaaatttgtccttgaatttaatccaggaagaatgtgctgtttctgacttgtcttcagaaaatgaaaactctatatccaacatgtttctcaccctgccagcagtcctgaacctagagccaaattatactgaccaagggttaggatctgctccactggaagccttaaaagcccccattcctttagcttcctccacatttcctatattccattctattttaaaaagggatgtgtgaaatgaccacgagtgagaaataccaacttttggatggtgattacctctgctgtgaagagggaggaaaggatggaattccttcagctgggtggtggacccacagacatttatgttatttttcataagctttctatagcaaatacttcggaacgatttttaagaggagtcgggggcaaatggcagagatggggtggggatgaatgtatgctctagggggacaaaatggctgcacgagaagtccacaggtgaggaggcagagggcttgtttaggaagaccaagttgcttatgggagccaaagcacggggtgtatacacaagggaggggagaaagagcaatgctgggaagataagatggcagcagagtggtgaggaccgtgaacacctggctagggaatgtgcgataaggtaggaaaggagagtttctgagtaagggaatgagaagattgcaggtatgtcttagggagcagatagaatagaagggagagatgcagaagtcagggaggcctagctgaaggagactgccagggcctaggagacagacaccgaggatgagggtagggcaacgtgactagaaaggatgaggcaaatgtgatgaagtctacagagaagtggggatgggtagacagaggagactccagggtgatgagaagaaaatggcaccattaagagaaacaagaacaccaaaagaaggaactcgggggagggagacaattgagttgaacaatttcagcttgaccatgagtctgggatgccaggtgaaaactcaagggatctccagcaggcagtaaggaaagagaaactggggctcaaaagagaggtagcactaggggaaaaaacatggctagggtagcgtctgctttgcctatctgtcagctgttgtcatgctcagatgaaagagtcaatggaaaaaggctgggtaaactctaaggagctttgttactatacaatttcatgtgcatggaagtgactaaagccaagggggtagcttaaagccacggggagaagaataaatgcagagcagcttgctgaggcctggaagctgcagaatctttacagaaagaccaaggtggaagaggactgcgagaaagacccaaggactcacatctccatggaatctgttctcgctggggctcctgtgagcctcctcctggccacacactccatggcctcttttcattctttatcttactgaaacttgcaacatttcacaccatggtctgctcccttccttcttgagattctctctcctactgacttccatcacagccctttatccaaagattttctactgctttggctgctgccacttggttgtctccactggctcttctcgctctccgcaccatggaaaagtgtccatgtcccccggggtcctctccttagcccatatctttttatgttacatactcttcccagctcatgaatgtctgtggtctttagtgctaccaatatgctaatgacttcagaagcttcagagtcaggtttccaactgcttctgagccatttccacgtggtagttgtagagctgtaagtccatgccttcagactaatttccccattgggcttatctacaacatattccttctcctgtaatatgtctattcagatgaatgggagcagctcctatctttcaagtgaaagtttgttcaactccatcttccaaatggccactcaagccctccaaatctctcatggctgtcccctcttttctatctccactatgactgtattaaggcccttatcacttacctaggaaactaaaataacttcctagttgggcttcctgacttcagtctctcccgcccctaacccatcacacacacactgcagctggagttctcttcctgaaatcacattggatatgtcattgtctgtgtaacttgcatactgcttaactgtgacttatgagactcttaaggctgctggctcttcttccagcctcatcctcttctgttccccactcctccatcaacccccaatgttccagctccaaccgatcattcaaccatcttcataacaaatggtgcttttccatattgttatacatgcgatacagaaaagtaccatatagacacggtaactctctacctgatatgctcctttttccttcctgtccagaaaattgttaccattcttcaagagttggttcaagtatcatctcctctataaagcattctatgacttgctacactggcataatcgtcttttcccttgtacgtcttcttccttctcacagcactatgcataccactgtaggctttgtcatattataccacaattactcaactctatatcctatgaggttatgcaggcctcagggtatagtattatgcaccttgcacagtattaaattcaccatggtgctcagtgaatgtttctggaatgaagacatgaatgcctgaatgaacgagggttaaggtatctttctcatgcactagagcacctaaacacaaagtgctcctggaaggaatcctgaaagcagtcttactcatggtagtctaccagattacagggtatcacctacctacagtaggccctactatagtcacaacattaacccaaagccaaattccttagtaccctcaaggccaaaaggtagctatgggatttctcaaatccagaagcaatgttagtattcaagatgccacaatgtagcaggagccatactgtggtcaaaccacagtgactaggcctttgccctctgagcagcactaacaacttaggagcccatttcctcccaagttcactcaatacacttttactgtgtattactgtctaccaggacactgtactagctaggcatgaaggaccaaatggactcagcatttgataagaccacagacatagcagcaaataaatatgacagaatccattcattcaacacacactgacttagcatcttcaatgtgccagactccttcccaagaactgaaagaacatcagtgaatagacagacaagcatccttgtccttagagagacaacaaacaagatgaatcagtgaaatatataacataggacacagtgacaagcactcaagagaaaaattaaacacagaaaagacatattaaaagtttagctaaagggccagggaaggtttcatagcaatgtgttaataacacagaggcatgaagaaaaggctgcagggacacaaagaaggaatgattccttcaagagaagctggggaagactccagagagggtgtggctcttgaggtaggttctgaaggatgactagcagcttctgaaaggggtggagaaagggcatccaggttccgtgagaatggcacatgcatgatgggagaaggaaaggctctgcgtagtttgagaacaatgcacttgggaagaagtgatgtgagtcaaggttggaggagtcagaaggacttttaggccataccaagagaatggatttcactctgtgggcaacagggaaccgatgatagttttggaactgagaaataagctggtcggcctcactctaaggacgaacacgctggagacggggcgtgggccagaatgcaggggcagaccaggcaaggagggctaggtagaagcaggccactgtggcaatctcaggacatggacactgtttctctacttctctgggcaacaggaggcagggaatctgcccttgactccttacaaaatagcagagctgactccagaatcagaccacacacatctggactcatcactcctactgcagtgtttacatacctgaaacaaacaggtgtccacttcaaaacgccagtgagatgacagctttttgtcaaacatgcaacaaaatttttttcagtttgcagcagaatccacagttaatgttcttgcttaggactttaattgaagaaacactatgatgactatgtttttagactcctgtataaccatttaaatggcattctttatatgatgttttctgctgtcagctgcttgcttttatacttggactaaatgttgtggccaattgctcaaaatgtttatgtaaaacttagtggaagaagaaataagttagtagtcagtgtcagacaggcattttattcacccactcagcactaactccatcctctagggcatcatatacaaacaaaaataaaacttgctgagaattcttccaattgtaaaagtaatacatgttcattctgggtttttgaaaaatattgacaagtgaaaggaagaagacaagacatgcataatccctttcttcagatagcccaaatactgaaacctttggtgtacttctttccagcctcttttctacagataatttttgtttttcgtagttgaggtcacactacatacacaaccttgtcatatcatcagtttgaataacttccccagttcatcatcagtgacagcataaggtggaactggctacacagggtgagtcaaaaagccaagagtacaagcagcaaaagggaccataatgtttaattgcaacttttgataattctcacatatattagcataaaatctttcaatctatcctaatttgacccttgggagctatacagaataaatcgaatccctgctccacagaaaggcacttcaaatattcaaagatgggtccatcatgtccctttttagtcatcttttcttcagacaagatcagcatttattttgatcactgctccaactgcagtcccttcactaacctggttatctgtgtctgaactctcttcagtttgttaatgtccctcttaaaacttggcatctggcttggaatacaacacttcagatggggctattgttacattttgtctggcaattatgttatacttctgttaactcagcctaggggaatattaactttttaatcagtcatatccaattactggttcaaataagcttggatccgttaagacagacctcctatcctttactgataacaactgagtaattgttatctatatcaattttatattattagttttgctccaatatcctaccaagttaagatcatttcaaaccctgatcccatcacctagcacacattggctagtatggggtttttcatacattggaaatgcatgtcttctatgtgctcctctgcattgcatcagaaatgctggaaaggaagggccctacacagcaagatgttagcgaccacccttcctagcattaagcctgaaatccataggctgtaactccacctaagtgtactgccaccatttggcccaggtgtctttaccggagtctgtcatatggccttggttccatcaagacaatgtgtcaataacactcccaatggttggtttcttttctaaggacttaaaaatcatgtttaaaatgattatttgtagaatttttgccaattgttgccaagggtgaacatgcagctcgctgttgttaattttcagaatcttctttcccattctggaaatctagaacattcactcatctccactcttacttaaaagtttgaacagagtcacataaataaaatgccctgtggcctgatccatgtacatgtccctacaagcactgtgccagaggagattccagaagttggggcagctataaaagtgggctcccacagctaaggcaatggggataataaacagcattttttcagaattcagacataataatgaacaccataaaagaaaaaaagattaaaagatacaaactaatctagattagaactgtcctaaaaaatggtggggtaaaagcaataaaaaagctacatttccccgacagcctcaaggtcacctgtgtagaagctgctgatgggctactctctgtgaaccctggacctctttccccattcacatcctatcaaaatatacctccccttcaggctgacctgggcaatgacaacccaccacatccactggaagtccttcagtgacagccacagcagctactcactctctcttccctttctggggcatctcttttccatgttattgtcctagtgatggaacattcctcaaaatgctgtgacaaacctttcatggtcagggattgaaaaggtagagtggcagtaagccataccatagtcatcctagttctacactgctacctggtgctttatcattgaacacctggaaaagttctagaatgctgggcttcacccagaaattcacatcactatcttcctctgtgatattttagaaaatataactgtgccaggaccacaggtctggatattctgatgcagtctatcgaggacatctgtatttttttatttttaacttttatggatactgtgttgttaagctccataagtgggtttcatatgtgcttctggcaaagaaccactgttctacacctaacttctccaaactagcaaatggttacaattactaacccctcccccaccattatgagggataagactttttttaattgaccctgttccttacatatacaagtgttagtgttaaatgagttttgcataagcaaaaaattaagagttgagaagcaaatataccccatgttaatttgacccacagtcaatcttgcaaagtagaagagaaacaatttagcattatctttaacagttagggtcatctttatggtcttatattctacttaccgtttccaaacttcttaaataaagacgataatttgtgatgtaaactcttcccttaatggggccattgaaaggacatatgtaaataacttctttgtctattaagataaaaaaagtaccctaaaataatggaaatagataccaagatacacaacaaatggcactaatttaatataaactattcagctaagaataactacaattttaaaaattactgaaaaggctgaaagcaagcactggcaatgtttctacattaccgtgctgggttgagttggggtagtgggagaactagtggggccacaccacctccaggcactaacagtgcttccctgagctttcccacaatgctgtcactacctggggcaaggtgacaatagaagtgaatgagaatactgctgctgctaccctaaggtggttgtaaaggtaactatttgagctacttcagccagaggacggcaactcacctgggacagtctcacggactaaccactagactgagagatgaggctaccaatctctaaccacagaaacataatcatgtttttaataaataaatgtcagcagtagaaatctttccagtttattctgtctttttttgtttttgagatagggtcttgctctattgcccaagctggagttcagtggcacaatcatggctcactgcagcctcaacctctcaggctcaagcaatcctcccacctcagcctcctgagtagctgggactatgggtatgcgccactgcacccagctcgttttttaatttttagtaaagatgaagttttgctgtgttgcccaggctggtctccaattcctggcctcaagtgatcctcctactttggcctctcaaagtgctgggattacaggtgtgagccaccgcaccaaacctttttctttttaatagtctagaatagagtttggctaggttcatttcaaacactgaagtgatataaaacaggtggccgaaagaatagtacatctttggtagaataaacataaggagaagctaaatcagaataattaattataatagaaatatgcctctcatctttcagggatgtccttgaatgtgttaatgactcgtaatgattttgaaatccctttctcttcaagttctaaataaaaaatacttaataaagctactttatgctagttccattagttaccacctgggttaaggttcaggcgctgatacctaccaccaaaacttcatatatgaagacgatcaaaagtaaaatatcttctttgctcttatccagaaattgggatgaacacatcccactggtctccatttcaagactagaatgtgtgcaagtttgtggactcagaagagaatttctcatggtgtatggctaattcccaaaggtacctcgcttaggcccgccatctaattagcacgaggttttagccatttaagctaaacaacccagatctgaattaatcaaaaggttccctggaacaatggtcatcacatctgcttcaaatacattgaagtctgaaaggagggtgttaatccacatataaaatttgcccagaacattagcacttggcttagaagctgtcagatgcttctatattcttaagccgtagtgatctagcccttccaaagttgatcccttccttttagtatacgtttatcatgaaaaataacatcaaaatattacctaaatactaacttccattttctgacgaatgaaagatattttaaagcaatatgttctcctatatttcaaagaggagaatgattaagccttcaagcctttaagtttatcattttaaagcatgcatcattgactggaaatcattttgctcttaaaaccttaaaccatgagagcttatggctccaatgagagactttcaagagataatccacatttttttcccctaaatcattctcagtctttggtacagacacaagaatatcactacccttgtgagcatgaagctctcgaaagaactctttaatcaagaaagggatgcagagagttctgtgttaacgcttctaaacaaaggtagcctatttgtctaagcctgactgctaaagagtaagcgggactgaagccacctgatcctgccagacttctcctcaagttatgcaaatcttatgtcagcaggtccttaccagtgattagtgtttctcctggaagtcgaggaacagcctcagtgagatctcgattgactccatctcgagacgtctagaaacaaaacagatgcatcagaagtaatgacgttacatttacacactgtttttaagcaactaggaatacaagccactagaaatatgttttttaaagaaaaagcattagagatttagcatttgggaaaactggcacaaaaattcaaacaaaaaagttacaatctggcaccaacattaattagatgtgtcaacttctagtattaaataatgctagcatgcttttcaataatattaatttttaaactacatttccaagcactttaaagttaacagctttcgggaaagtgataaaaagtaaacattaagtgtgttctatagatacacatacactgtagcagctttctttttttcatattcagccatcttttgggaagagtaggaaggaaaacttcaattccacagaggcttaactgaataacagcacagccattagccagaatcctattacaatgcccgaaaatcattgtgattacctattgcgtttcctatttcactaagacccttcctctctttttacttcctcacatttactaagatccctgtcctaataagaggtaagagtggtctgtcagagaacttttgagctggcaaaagtcttaggagccatttgtacaaattcttcacatcactttactatttctctaggcttcctggctttagaggtattcccaagcatgtgcctcattcaatcacttccacagctctgctaggtgggcacagtaatattaaccactacaacctgcaggcgagttcgcagagcctaatttgccatagctacccattgtctttcaggttattcagctgccctagtggattaatacgaagatgtgttgcaggtgctagtctgatgacatttgaggcacatcactaacatctgtttgggcaaaaagtttttttcagcagtatttcatttttttctatttgttgtccaaaatcacactgcaatcatttcataagtgaagttactcatgcttccgttagagcagttttgtgagtattaagtgaaaaaatatatatacaagcacacttttattttttgagacagtcttgctctgttgccaggcaacagtggtgcaatcttggcttactgcaacgtctgcctcccagctcccaggttcaagagattctcatgcctcggtctcctgagtagctgggactacaggtgtgtgccaccacgcccagctaatttttgcattttgagtagagacggggtttcaccatgttggccaggctggtcttgaactcctggcctcaagtgatctgcctgccttgaccttccaaagtgctgggattacaggtgtgagctactgtgcacacttctgtaaattatcagaggctatgcaaatggagagaattattatgaaacaagagaaatgtgaattgtatattcaggtgagatataagctgtcaaagaggggtgttatgctgaatctttaatgtttttttttttcattcagaggcaagaatgaaaattcctagccaatttaaaaaattttctagtacttgcaagctaaacattttaaccagctgggcaagacaaactgttctcagccaggaatgccttcctcaatgagaagcaaaaccacacaccttatataaattgtaagagaggaaagaaattatcaccctttaacactccctctcactaactaaaaacaggcataacgagcaaatgcaatactcagtataccttttaaataccacagttctaggtcaaccacaaaataagggaagtgaatgtctgattaaaacaggataacatgggattaacataggctatacattataccagagcagcattacacaaaggatttatagttacattcttgaaattactcctgtgtttagaactgattctggtaacataaaaatacttaaatacaataaaaacatataatcttggagatgaggatggtccttgtaggcacccaaaacagaaaatatagattgatatatgtgatcacataaaaactttaaacttcagtatttcaaaatcaaaataccataaatacaattaaaaggccaacaataaatcaggaagaagacttgtaacatattatagagctgattatcaaaatataaggaacaagccaggtgtggtggtccatgcctgtaatcccagcaatttgggaggctaaggcaggtggatagcttgaggccaggagttcaagaccagcatggccaacatggtgaaaccccaactctactaaaaatacaaaaattagccaggtgtgatggtgcacacctgtaatcccagctactcgggaggctgaggcacgagaatcacttgaacccaagaggcagaggttgcagtgagccaggattgcaccactgcactccagcctgagggacagagttagactctgtctcaaaaaaaaattatacacacacatacacatatacacacacacacggaacacataatcaataagaactcccctcaaaatccccaaaagccaaataaaggacatgaacaatcacttcacaagagaaatgcaaactaataacaaacacacttttatttacttatttgagacaggatctcactctgtcgcccaggctggagtgcagtggtgagatctcggctcactgcaacctctgcctcccaggctcaaacaatctcccacctcagcctcctgagtagttggaactatgggcgcacgccatcacactcggctaattttttgtatctttggtagagacagggtttcactatgttgcctaggccagtctcgaactcttgagctcaagtgatcctcccaccttggcctcctaaagtgctaggattacaagcatgagccacctcacctgaccataaacacacttttttaaaaaaggttaacctcattagtaatcaagaaataccaatgaaaagatcaccttttgctcccttctgattgcttaggcatctctatccacctggtgggagtataaattagcctttctggtggataatcttagggccttaaagggccatgaataaagcttattttaaattaatcccttcctttgaatgcacattccaaaatctccctctaattacacaatctccccctggataccttgaaccattttctgttaaagttgtatttgttttggttatgcaacaattttatcataattagaaaataatgccaataattaggaaggcgtagcagcctgctcagcaggccttagccttccagtatgtccttcagcaacctttccaggtggaggattgcctagtaccttaaacatgaggtctagcagtaatttcacgagacagaggttttcaaaaatgaagttatgtgaaaggatttacaaatgtaaaactcacttaacacatataaggtattctatctaaaagcttttctgggccggcgtggtagctcactcctgtaaatcccagcactttgggaggccgaggcaagtggatcacctgaggtcaggagttcaagacaagcctggccaacatggcgaaaccccgtctctactaaaaatacaaaaattagccgggtgtggtagcacacgcctgtaatcccagctactagggaggctgaggcaggagaatcacttgaatctgggaggcggaggttgcagtgagctgagatcttgccactgcactccaacctgggctacggagcgagactctgtctccaaaaaaaaaaaaaagcttttctagaacaaggtgagacaataaagaaaccacatgtataaatgtatttatatgtgaatgaataataaaattcataattcaataggccagcccaaaatgacctaatattcaaatatcaaaataaatgcaaggaaagagacagataaatctgaaaattcaacttaccctcttaatagactcattctccaaggagtgtgaattatatttagaagttgatgcagaagccatcctggaaactctaccaagaaacacaacattcaatatcaactgaatttgtatgcaatttcaaacatatgtgacatctgagacttaaatatggcaactgagagcaaacggtactactttacaggttctatttccatactaggccccagtggtaataagacatagaaacgatgaaccagagcacaggcagtatgtgagagctccaataaaggtgcaggggactaggggagaacagacaaggggagctaaatgcacaagggggagctcagcagaagacgccatacacattccaggaattttaattcgtagtgctctaattgccatctaaaaaaacttaatgtttattaattgtgcaacaggcctcaaatttccatactccttattttttaaagataatttagaggcagccgagcagaatgaaaaaagaatggacaatttaactcacactattttctctattaagaattttgttttctccaaatgatggcagtttagagtggcatggatttgactgaaatcaaattggtaagatttgatttaatcagtattttctagggaaagtatatacttcatttaaataatgcatattcatcacaattcaggcataaatgaaagcattctattcagaacatacacaaataccattttaacgcaaggatttatttagacttaagaagattacagcaacaacagaacactaagtaatgctttggttattttatcaaagtttaggacacagatagatacatataaagtcagcgggaggtaaaccacatccaattcaacaaggtgactgtggatatttataaatatctttttgccaggctgtattaagagcaaccagacacactaacaaaatccagcaatggagaacattaacccatttatgccggaggttgcaaattatttttgtgaaaaatcagaccttggtgatgaccttgagcagcaggatgtaaataactcccacaagcttagcgttccaatagtggaacactaggcataaatgggttaacacaccttggcacaaaatctagtgggatttaacagcttcacagtactggctactgtccttaagaaatagtcaagaaaggtgacgaagtcacagaaaaagacagccaccaggatgaagaggtggggagatggccagataggggccatcttacaaggttaggactgtcaggattcccccgtgagagttcaacactacaaggccaaggcttgtgtctgtctggttcgtggctgtatcctggcgcacactggaactcacaactatctggtgaatgattatgcggcaaatatacaatactgtgaaatgtcatgatggggcaaacatgtatactagttcaccaaatcccagaacactggaactaggcaactaccactgatgcttgaaaattaacaattagagcaaaatacgtctttatagaaagagatactcaacttagaagagctgaaactacctacaggtagcacaatgcaaaattaaaagtaactttttaaaaagattaatgaataacactaaaatgaattaaattcagacaaaatcgtaaaatatgctttgaaaaacctttctaaccttaagttcatgtccaagcaaaataacccattattctcagagatagcagaatggatgagatgaactatggagcaagtcagatgtatctgctctgaaatttttctattgacaaaacaagactatatattaggggcagattttcttcagtaacagatataaaactaccttttagtatagatactttaatatttaaaatgcttcactaatgtaagtcaacattttaaaacaaaaagttaaattcttactatcaagtcagtagaaaaaatctaaaatcctggttgtacagtcaactcagtcaacgtcaccaccctgtttattcatgggccataaaagaatgatgagtcttcctgctatttctgattttcatgaaaaaatttcaatttaaaatgaatataaaggacgaaatccctcattttcccttcatttaactgttttactacaactcacataccatacagttcacccttttcaagtgtacaatttaaaggtttttagtatatccaaagttgtgccacccatcaccacaatcaattttagaacacttttatcatcccaaagagaaaccccaccccatacccattagcagtcacccaccactcccaatcctccagcaaccacgaatttgctatccctataaatttgcccactttgggaatttcatataaatgaaaccgaacaatatgcagtctttatgtctaaagctctaatttttagaggaacaccagacactactactactgttaatagttggatcaagtatacatccgagaaatccaaaggtccagataacatgtgccagttccacaatgaggcttactttaaaatctcatcagtgagcctctctttgttgaatggttttgattgatccctgaagattatagaagctggaacagcatcatgctggtgtgcacaaatgttgcagctgactacattcaaattccaactctgcaactcaccatttgaccttgagtaggttatttaacttctctgggctttggttgctattacccccattttacatcaacattattaggtgaaacaaatgaattaatacattcatgcagggcttggaaccacacagtgtatctgttaacaaattactagtatttttaaaatttttaatttttatgagcacaaaaggatagctagtgaatgccaatgtcttagccaattctacaaattagtcctgaccttggaaatactaggagaaaagttaactaatacagggatagcgcatggctagcagccactcagttataaagtgctttttgcttaaaaaaaaaaaaaaaaagacaataatgactctaataggaaaatggaaagcagtgtagtactttggaaaatgtactagacaggtgtgtacaagccctgggctgtctctaacttaccaagcaaagaaagctcatccatatcttcgtgtataaaatgactatgttagtgtaaaggcagttggatgataattagaagctatagtgaagtctacaaaaatcagctacccttttggttacagagtatttcatcccaaagccctaacaatcaagtttttttatcctttttatttaaaaaacaaacaaaaaaatgttgatttttggctaccttggctttaaagcaaaaattaaaagttgattccgtatatatatgttaactacagcattctaaccagaggtagacttctatcacttttgatcccccaaaataacctttgagatgatttaagcccaaccctctcctattacagaggagatgcggggggcctagagggtgtgtgacaaggtcctggagtgacttactggcagggacaactctagcctaggtctccctgcattgcagagtcccttctacctacagaaaagtgcttctaagtggtctctggaaggaaaccaggttgcacgtgactggtcccaatctcagtagaacagcttgagactaagaaacatagttaagagaactcaactcacctagccaaccaacctttggggcctctaagccccaagaattttatgttttatttatttacagcacctgtaacagtgcctggcacccaaaagatatttaacaggtatttgttaaatgagtgaatgaactgggcaattaaggattggccaaggaacataacagttgttggcagtgtaatatttcacttaagccacaagttcatacaaactcatgtttgaaatggtacgacaaggccttggctgatcaggatggtccaggcagggtggttctgggcagcaaatttaagtgtatatactgttatgtagttaactgcagggttaacttgtacccctttgaaacgatttgcactgaaaataatttgagtaatgctatcttcccttatagacttttccatgaacatttcaaattaaggtacagccgtcccagtacagggggctgggattggtcagttgaatctgtggaggcagatacaaaaacctctttcactgcgccctttttccagactaaggaactgtttttccttttctgttgaatatgaaaaacaacaatacacaaacctgaagcacacattaactaaaaacattaaaaaatgcatgccattttaacgcttatgttaagaatctaaaagcagcagaactagaaaataattttgatctctgcctcatagggcctttgcaagcaaactgtaaacaccacggagagctctatttcccatcgtcacctgagttgagatcaatggccctgagtggtttttctgaacttttctgtatacaaacaaaacagtgacaaaggtatgcagcttttgtcttttgatgagcctttaatgtggtttatgactctgtgttggcatttacgttaagttcaatcatgctctttctctggaaagatgctgcttatggaaacatactgagacttaaaacttgacttctaaagtttgtcagagaacaagcagcctctccgttcagaattccaggtctttctaaggtagttgtccttacttagaagtctgttttcaaaaagatgccaaatctctttggcagtggtgctcaataccatcagacccgaaactccctttttataaaacaaatttctgtaaagtcccctttgctaggctgaaatgaaaaccatggatatcctcaatctaaacatgatacaaaatcaatatactgtactaactccaatataaaggagaaataaaaggacagtgatttataataaaataatgtatttttcaatgaattacaccataaccaaaacatgcccccatttccaatttggcctctagggggagcgtcacccccaatgagaaccattcacagagttctgtacctggagtgccagtaaacacaggatttactataaatttattctgattttttgcattaaagtagcttggattgtaggccacctaggatgcaaaaaaatgaaacataccttgagacgtcctcaaccaaatcactgtgaaccaagataaatgttcatattccagccattttgagaccaggtacaccatcaatttaacacatatatttgtttatttggggggaagaagtgctcaactcacatgaaaataaactatgatctgcaaaagcagaagtttggttcatttttatacattttcctttgaacaagggactgacaaattttccgtgtaaagggccagatacccagacatttctgttgcaactactcagtactgcgttgtagcactgaagcagcaatatgtaaataaatgatgggctatattccaataaaattttatttacaaaaacaggctgtcacgccctgcattaagctgttaaaataattcccatgtgaaccgtcttcagccgaagtacataataatcatattctcttaaactaaaaaacaagctattaaccccaccattgagagcttgtcaaaatgccactatgcgcccacctacaaaacagtgtgatacagttgaaaaaaaggaagggattctgtattcagaccaatttgtgtctcagatcccaattctctcacttaattactgcagtttccagtctgtaaaatgggtgtgacgccagccctcacagtgctgtcatgaggaacaggtaaaattatagcacagcagatggcataacaaagatgctcaaataccagttcccttcctcctaccagagatgctttatgcttttttttttttttttttgagacagagtgtcactctgtcgctcaggctggagtgcagtggtaccacctcagctcaccgtaacctctgcctcctgggtttgagtgattctcctgcctcagcctcctgagtagctgggattacagatgtgcgccaccatgcccagataatttttgtatttttagtagcgacaggatttcgccacgttggccaggctggtcttgaacccctgacctcaagtgatccgcccacatcggcctcctcctgtggtgctaggattacaggcatgagccaccacacccagcccagtgaactcttaagtcattccccaaactggtgctaatatgttaggttggttgtccacaaaatataccatatccttgattgcctaaccattctgcacacaggttttctaagatgatcaatctaaccttgccaagactccaatcagccttacagtagtttaccttcaaatatgcctccttccattaaaaaaagaaaacacttgactcctagcccagggaatctttctgtgaaatacttaacatacagatctcatctcattactttctattcaggctcagatatctaaaaataggctacaaatctaactatatttactccaaaaaaggatcccccaagtaagtggtttactgtccacatagacacatgtaacagaagcattagagcttcttgatttgtcttggtcacttcaaatcttagggctacagtgtatttggtttgatgattcctctttgaaaattatatgatgctatatagtatttcatttaaaatctcactctctgtataattttgatatttacaattcattttaaacatgatgatatacctacccctatttctttaaatgttgcaaagacctttggctaaaaataatgtaattcagactcagtggagaatgcattttgaatcattttttccagtggctagtgatggatttgggctgatctcttcaccctatttcttggtcccctcacgacaaatggcacatcttcaagacagctgattggctttagtggcatgagctgtggccatggaacagggtaactttagaaattattcataaattgaaagtgatatggtaagtaaactattagaaaagtcaactactatcaggttatctgtttttaatgtacaaaggctacctagcaatactgcacacatttaaacagatcattaaactcaccaatggattttttaacagtcaaatacctgccagtaaacaaagttttaaaataggaacaagatcaagttcccgtgcatctgccaattccaaaactcatgaacccagctgatctgctcaatgaaaaaaactgcattttattgaactattttcccctgtgagaactattcacaaaaagtacattttaaatttataagtaaacagtaacttatttagcaaaagttaaaacagtaattgttgaagaatagaaacgtataaatagttataactatgatagtaacaaaggtgccagatcaaaacatctccttactttccaagaaccttctcaggtctgggctaaaggaccccaaagaaaagcccaggcattgggcattactgatgaagattcttctgagcagaatcagtagtggaggagggaggaaaaaaggaactctagagtggatgtgcacagtatctagaaaactgaagagaggagaaaaggttggagataacctgccatttgaaacaattcctctaggtactctcatttgaaggcagaagcaggggcttcgttggcatatgctttgttggcatttacctacttcaaaacatggaaagcttttcctgacctccccccacacacacatacacacacacacactctttctctctctctctctctctctctccacttctctgtacaccatacatatttctaatatagtcagccctccacatccaggagttccacatctagggattcaaccaactgcggatcaaaaatatttgggaagaaacacaaaaaacagtatgacaaaaaataatacaaatacaaataatacaaatagaaaaatacttcaaatactaatttttatttgtatttacatagcatttccattgtattaggtattataagtaatctatagaggactgaaagtacacaggaggatatgcaaggttatatgcaaatactatgccattttatatcaaggacttgggcctccaaggattttggtatcctcgggagtcctggaaccagtttcccgcaaataccaagggacgattgtatttcatttcttaccctgtacttatgccttgatattttgtgtcccgtctcttagatttctagaacttcctaaggccaaggaccatgttttccattctggcaccagcacaaagcacagtttgggtactcagtattccgtgaagaaacaaatgtagcatcaccctcataaactttcatgactttggagaagttagtcatcagtcattaaaggtactccaacctacctccctagggctgatttttaggtttataattcccttgcatatctttaaaattttccacatgtatacatccctaaataatatgattttccatgtttctgaagtcttatgtaaatggaatcattatatattcttctgccacttgcttttctcacatagtgttgagagagtcataaatgttgatgcatatagttgtgttccactcattttcacagctgcatagcagtccactgctttgcacttggtttttccattctcctcccagtgatcatttgagctgtttccaggtttcaattataaacagtgcttttataagcatctttggaaacgtctcccattcctagcatgcatataagaaccgtatttttgtgccagattttcatatatatatatgaaaatatatatttgctgccatatataaaaatatatttgctgccagatcaggtatgggaaatatatatttaatatatatatttaatatatttttaaaatatttttatatatttaacatatatttaatatatatattttaatttaatatatattttatattatatatatatatatcaaatatatatatatatttaatatatatttaatatatattttatatatttgatatatatttatatatattttgtatatttaatatatatatttaatatatattttatatatattttatatattaaatatatattaatttaatatatattaatttatatataatatataatttatataatatatataatttatatatttataaataatatatacaaattatttatatataaattatatataatatatataaattatatattatatataaattatatataatatatataaattatatattatatataaattatatatattatatataaattatatattatatataaattatgtataatatatataatttatatataatatatataaattatatatatttataatttatatataatatatataatttatatatatttataattatatataatatatataatttttatatatttataattatatataatataatatatataatttatatatattatattatatataatatatataatttatatatatttataattatatataatatatataatttatatatatttataattatatataatatatataatttatatatatttataatttatatataatttatataaattatataaatttataatttatatataatttatataatttttatatatttataatttatatataatttatatatatttataatttatataatatatataatttatatatatttataatttatataatatataatttacataatttataatttatatataaatatatataatttaatatatatttaaatatataaattataaattatataaattatatttaaatatataaatatgtatttatatttatatatttaaatcaaagtatctggagaagatggataatagatgaaaacataggcaaatccaccgtttgaaatgaaatcccaagcttgtcaacactctaattcaagcagatgggcagtctattggtgtcctggggctgctgtaaagaagtcccacaaactggatggcctaaaagaacagaaataaattctctcacagttctggaggcccaaagtccaaaatcaaggtgtcagctaggccatgtgccatctggagcctctaggggagaatgcttccttgcctctccctagcttctggtggtggctgcaatccttggcattccttggcttgcagcttcaccactccaatctctctgcctgttgtcacatggctttctccctgtgtgtctgtgttttcacatggtgctttcctctttcataaggaccccagtcatgctggatgaggagtccaccctactccagtgctgcatgacctcatcttaactaactacaactgcagtaacaaacaagaccccagtctgaggaaatagggactagggcttcagtatatctttttaggggacacaattcaacccataataggcaggaggttggctacagaaattaacaatctataaaatggtcatgtcaacatatggttacattcagaacaatttcatttgtcaatctatccataagcattcaatgaatacctatgaaattaactagtactgaaataataatatggttttttagaagaaataatgaaatgacaacaagccaatcattctgagatactcctaactcagcatatatcattatttaaatcttgtttccaaagagttcacaatcagtaactatatagtgggcagctactctggaccacaatggagagttccccctcccctcaaccaaaaaaatttgagatatgtcttcaaggagctaaaaactgagttgggaagatgacaaacaaatgtttagataacaataaagataattaatatgtataaaaaaggttaaatagtaataaagacaataacagaggtgatacaattaaagcaaaacagagtatctgcttatgctaatgatcacggctttcatttacagatcatctactacctgtcagacattgttctaatcacagattaagtcatttaatccccaccaaaaccttaaaaggcaactaggtattactatcatcatatgacaactgacaaacacaaggaacaggaaggttaaacaatttgtctgctaataactgtcaaaggtggaactgaaatctaggcaatctgaccggccctctcatccactaacagatagatatctgtcattctcattctctcatagatgatcatattaaaatgaggacatcatgcctcctgcttgcacagctggataaaaaaaatcttttcggaatttcatccacgtgataaaatctgatggtcacaaagaagaaccctagacttcactttaaagatgagtcaacaaataggctttttcccctgaaatccatgtctgtgagtcactgaaacagcacaacccttgattgtctactatttatttgtatccacttagtctttattaaaactatcttttaaaaggagaaagtttttattactagtgcacaaaacaccccatgaggtgcaactatcatgtaatgaggcatttgttaaaaagcctgtcagatcatatatagctgagttattcttcaaagtagtcccctttgatggtgtacacaaattccagcaatgtggccactgttcaaagtattctttgaattattcttttgaaactgcctttggaatttaaagctacataaggtaccatctcatgaactttaaccatatcttaatttttaaaccaaaaccaatgctccatacagcaccggtgcccattctatgtattaatagaggtgatacaaaatgattttggcctagagcctttgaggatattttttttaaaggtgcgaggatatttttttaaaggtgcctggtctctgaagtcaatccaaagaagagttccaaaatacattgaataatttggatttggaacttcctgaccttcctctacatggggcttttggaacgctgcctagggtcttttgattgttgagaatgttgggcttgatacatcttaattagtcctaacttgcaagagcaggttgaccttgaaggttagcagagataagcagtaggagtagcagcttgcccaacaggcagtttgccatagtagagaaggagtatgcaaagggaatccccaaagatggcttaattaggatcctgggagaatcagaaggagaaagacttgccatgacctagagagtatggacaatagttatcttcatacttggagcagttacttcttccagtcacaaatacaaacaaccacgtatccttgttacagaagaaggtgaaaggactgaacgtacatatttttataacttggcactattggcagacaaggtttcacagatggggcagaaataacctgaaaaaaaaaaaggcagaaataaaaaaggcaagatgaagaagaaccaaaaccagtgttaaaagaatggcaaggaaagagaggatgaagaaattccagttctaaaataatgatacatgtgaatctcgcagagaagatctatgtcttttgaaggagcagtatatgctgctccacaaagaattcccaagatccagatggaaattctgttatcgacactaggaggaaaagctgggtagtggtggttaagaatgggtataaatgtggtgatatgtatagtcagtaagactattcatgaggtgtgctatcttcctgaagattgtatctgagacgtggcttctattaacgtaattcaacatctatccatgatttttaaaaacaccctcaggaaatcaggaattgtcaagggcacctatgaaaaaccttcagctgacatcacacttagaaagcatttcttctttcaccaataagagtgggaacaaggcaaggacggtcactcttatcacttgtatttaacatcttttagagcttctagcaagttcaaaacacataacatattggaaaaaagaagtaaaactgtatttacagacaacataatcatgtatgcaaaaaaaatcctaagaatactacaaaaaaactactagaataagtaaatttagtaaggctgcataaaacacaaagccaatataaaaattaattatatttgtattgttagcaatgaacatatgaacactgaaatataaaaatactggcccagtgctatagttcatgcctgaaatctcagcactttgggaggctgaggcaggaggactacttgagcccaggaagttgagaccagcctgggcaatacagcaagaccctatctctacaaaacataaaaaaaaaaaattagctgggcatgggggcatgcacctgtagtcttcagctacttgagaggctgaggagggaggatcactttagcccaggaggttgaggctacagtgagccaccatcatgccactgcactccagcttaggtaacagaacaagaccctgtctcaaaaaactttattttaaaaatgtcatttgcaataccaaaaaaaatgaaatacttagggaaacactgaacaaaatacgtccaagaatcacacactgaaagctacaaaacattgctgagagaaattaaagacctaaatacatggagaaatattgcatgcttgggccaggcgtggtggctcatgcctgtaatcccagcactttgggaggacgaggcgggcagattacctgaggtcaggagttcaagaccagcctgaccaacatggagaaaccccgtctctactaaaaatacaaaattagctgggtgtggtggcgggtgcctgtaatcccagctactcaggaggttgaggcgggagaatcgcttgaacccaggaggcggaggttgcagtgagctgagattacaccattgcactccagcctgggcaacaaaagcgaaactccatctcaaaacaaaaatatacagatagatagatagatagatagatagatagatagatagatagagatatatagatacatatcgcatgctcaaggatcaaagactcctaattgtcatgatgtcaatattgatctacaaagtcaatgaaatccctatcaaaatcccaacaggcttggacaagatgattccaaaatttgtatggaaaggcaagcgaccaagaatattcaaaacaatcttgaaaagaaaaaaaaaaaaaagttgcagtacttccactacctgatccccagacttattataatgcctcagtaatcaagacactgcagtactggtataaggatagacatacagatcaatggaacagaacagagactataattaggcccttctttttgaggtcctagcaatggtcaattgattttcaacaaaattaccaaaatgtgtgggccttttcccacaaatgatgctggaacagtttgatgtccatatggaaaaataaatgaatctttacccttacttcacaaaatatacaaaattaacttgaaatggaacatagacatactagttttatattgctgaataacaaacttagcagccataaacagcacacatttatcatctcacagtttctgtgggtcaggtgtccaggcacagcttagctgggtcctctgctcagggtctcacaaagttgcaatcaaggtaatggccaggctgcattctcatctggaggctcaactggggaaaatctgcttccaagctcattcagagtgttggcagaactcatttcctttaggctgcatggttgaaggccctggctttttgctaagcagcttttagttcctagagaccacctgcagttcctttctatgtggccttcctcaatgtggctgctcacatcaacaagtcagcaaagagaatctcacctcggggaggacccagaccttcttttaagggttttgtgctgattaattcaggcctacccaggataacttctcttttgattaattcaaaatctactggttgtgaccttaattatatctgtagaatccctacactttttccatattctagtctatattctagaagcaagtcacaggtcctgctcacactcaagggaaggggatcacacaggtataaacaccaggggttggaaagatctgtctgccaaaacagatctaaacataagagcaggactaaaaaagttctggaaggaacacaggggaaaatttttgtgaacttaggttaagtaaagatttcttaaaacacaaaaactcaaaccataacaggggaaaaagtaaataggacttcatcaaaatcaaaactccttgctcttgcacaggcacaggcacagttaagaaaatgaaagacaaaccacagtttgagagaacatgcttgcaaatcacatatctgatgaagtacttgtatccagaatataaaaagaaccctcacaacttcagacagacaatccaatttaataagaaatgggcaaaagatttcagcaaatccttcaccaaagaagataaacttaatggccaacaagcacataaagacatgctcactattactagtcactaggaatttgtaagttaaaaatacaatgagataccattatacacccagtcaaatggctaacattttaaaggcagacaattaaagccagtaggaatgcaaaatggcacaatggcatggccactttggaaaacagtttgacagttccttgtaaagttaaacataaactaaacatatggcccagcaatgccacacctaagtatttacacgaagcaaataaaagcatgagtccacacaaagacttgtatgtgaatgttcatggcagctttttttcaaaatggccaaaaactgaatcaactcaaatgatcaactactgaatgaataaattacattataaccatactatggaatactactcagcaacagaaagtcaggaactgctgatacatgcaacaacacaaaaatgaatataaaaagcagtatgctaagtgaaagaagccagccacaaaaataccacataagcctatccttgacaaatttcaaagaactacgagtgttcacatcatattctttcaccataatgcagttaagttgtaaatcagttttgaaaatacccagaaaatacatttgtaagtaaaaatatacttctaaacagctcgcaggtgaatgaaataatcataatagaaaatatcacaactaaataatcatgaaaatactatgttttgaaacatccaaacagcagaataaatctaaagaaaggaggagaaaatgaagaatgattcctggtatattctttaagtgaaaagggcaagaggctgaatagtgtatgaaatatgtttttgtgcaagaaaaggggaaaatacatgtacgtgcttgctcaaatttgcaaaagatacttagaagaacaaactaataagattgatcatctacgggggggaaagaaacagaatacctggtcagagatggggtgaaagcaagacttttctgaatataccttgaaataaatgtgacttcaaaatcatataaagtttttactcgttaaaaattaatcaaaaaagcaggggaaaagccctaaaagggaaacaaatgaacataattatattatcaagttggtgccataaccacaactgacaaacctctggttagactaataaagaaaaaaggagggcacaaacaaacaatagtaggatgcaggaatgaaaagacagacacagctatagatttggcagacatttgctggtagtttataatcttccaggccccaggcagctccatgtgcaagttctagcaacattcaaggaaccagtaactccaatcttatacaaacttccagagaacagaaaaagggaatatctcaactcactttataaggctagcataagcatgatactaaactagaccaagacagcacaggaaaactaataccaaatcttatgtatataagatgtaaaaatcctaaagaaagtattagcaatcaaacccagcagtaagaaagaacatgaccctgttgagtttatcccagcaatacaaacttagttaatgctacaaagttatattagaaaatcccttaaaatagcctaccacattaacaagttcaaggagggaaaacacaggttctccctcacgcctgtaatcctaagcactttgggagactgaggcaggagaattgcttgaggacaggagtttgagaccagcctgggtaacacagtaagaagccctctctacaaaaacacaaaccaaaaacctatctccataaaggaagaaaaggggcttgataaaactcaacatccacttatgaccgaaaaaaatgtacactagaagtgcccctacacaaaacctagagtaaacacaatactttatggtgaaacattgaaagcaagagccttctcaagtaaagatcttgggccccaccccagacctactgaatcagaaactccaggcatgatgccaggaatttgtagttttgcaaaaacccctcaggtgattatgatgtggcttgctgctctgagtgggagccacagagcaacactgttggcatcacctgggagcttgatggaaatgagaagaaaaagctctccgggcccatcccggaaccactgagtcagaatctgtgtttcaactcgaagtccaggtgattcataaggcaatgaagttggagaagcgctcctggtagtgctgcacgctgggaccactttttaaaaatgcagatgtcaagagtctcagcccagatcaattaagttcgaatatctgtgggcgatgcccagggcagcaagtatgtaaaactccccaagtgattctaatgagcagcaggaaaggcaatctcctggtccgtggtattccctctatgaggaaacttctgtttagggactctgcaccagctctgaaaagccagagaagaaagaggcattcctcgagttctttgaagttcccctcaagaaagaagattgcatttcatacatataccaatggtgcctttttaatatggcttacaaaactaaaaactgaaaccgagaaaaaaccctgtagtcatgagagctgcaggaagttgcagcggaggctgcaaacccagaagtcagacttgcctgggttcaaatcctgatattactgcttcctaaacgcttcagcttagacctaacctctctgaaactcagtggggatcttaacagtttttacctcaaagcgatgctgtgaggattcatatgagacctgatgtaaaagcactgggctaaggacttggcaaagattacacctaatattaatgtaaattatgactgaggcggctatttaagcattgacagtgaatctgatgaaatcctcagcaaatcaagaccaaatgtatctctccacagctgtagctcctgaacacttgaactgtggctaatccaaactgagatgggctataatgtaaaatatacacctgattgacaatttagtaccaaaaaaggaaaaacgtgtcattattatgtcgatgacacattgaaatatttcgcacatgctgtgttaaatatattaaaattgatttcacctgtttctttacttgttcaatgtggctactagaaaattttaaattacacattctctattggctagcgctatcttaaaggactgggaagccaggatatgagctggtactattagactatttccgaactttaatttactgcaaaatcacctgggggcctcattaaaattcacattcagcttaaggagtcggtggtgggtctcagtgggtgaggatggggcttgaaattctgcctgtttcaccagctcccggggagcaagggcaatccccatcaataagaaaaacctgtttcatgccataggcgtaatgggaatctctggggagattattagagttgatatagtgaaggaaggacatgtccagcagagttagactcagcttcaactttgaaaaaatcagttctctctccaagcaagggattcaaagaggtgggggccagcaccaacggtcagtcctccctttgttagggcagtagggacctgtgctttctctcccagatccagaaccactgacatgggcaaggaacacctcagaaccaggaaactcaaaatggaatactggctggggtttctcatatcctcctagtcacataacccgtgttaaccgcagcgccctcctggggtctcactgaaaccaagtgcaaactttccttcttactgttatccacaaacagtactgacacgcaggtatatttcatgtcatggccaagggtcactgctgtgcaggcaggtacatttcttatttcagtaaaagagcttgggccaattccaggcctgctggattccagcatagtacctattctcctaaatccccacctaagttgtctcagggccataaagcaatttaaaagtcatataagggaatttaaagcaccaccacctgatgctaagaatctaccttataacccacctctgcctctacatctcccaagaaggggaaaggataactgatgtagcaatccattacattccaagcaaaaggctctgggaaataaacaatgcttccttctcacaaaaaagttcaaggacatgctatcaaaatataacaattatcacatgctaaagaaagggcattgctgtgtgctgtcagggtttggaggcaaggggataagagatgaatgagttacaaacaacttttatttttactttcaattattcccccttcaacttcccaccccaaacatactagcaagcaaagcaaaaactaatctgtactcaaactgctcatgccaagagttcaaaaatcaagaagctgagaagaaaagggtggcaagacaatgactgattcaaagaactttctcatttgctgtttgaccacggcaagaaaggttaagcatgagctccatttcatctggcagacagggagcatgatctctagacatgcaacagaattggttacaatgatcatgtgtgaacaattctaagctggcctcctttgtctagttcaagttaaataatgtttactaaatgtctactgtgtgtataggaccatcttaggtttcagacaatcagaaaaaatatctccaacctcgccctttttattacaatcatagaaaatgaaaaacatactgaaatatgtaggagttacctattaagacaaacagtcaaggaacagcaatactaaactaatacaagtacatgaaattcattgcaaagtgcaacttacagagacatttcaagatactgagaaacaactttaacgagaaaaggccgctcaggcgcctgccctatcactcaggagcctgccctgttccagcaaggaggatggtacagacctggggagctatcaaccatctcttccccagagcctggatcgctttttattctaaccccagaagcacaagcatccagtctagtatggactcaggagctgcggtcaggtctcgattggaaaagagaaagtcttccattctgagacacttgggagaggcaggcaacattccctgaggctgagcttgccttgctgtcaccctgtgattgttggttatacactactaccattttaggaatacataaaacaaaaacttgttatggtataccagtgacatcaggcccctatgaaagaggcaatataaatacctgcatattttaatgatgacagaagagggagattgaggcagagaggccacacctacagccacagggaagacagtccaagaacaggaaggacaactgccctcttataccagttctccaaatagcaactgcttatacaacacattcatgcaataataataatgctgcacactttacaaagggctctgaggcacatttgattctctgacgaactctggaaacttggcagggcaggttttattagctctatcttacagatggaagagccactagcagcaaggttaaatgacttgtccagtgacacagagttaaggaagagaactgggacctgaactcagcttctggaatccaaatgcaggaagctttctaccacctcacacaaacaaaaggctcatttaccatagttcctctggtagaaatagaaagcactagtagtacacaatgccaattatctaaagagatgcctccacattcttaaaaagaaaaagatgagactgtcgtggtactcacagtggaaaaatacactgcaaagatttccaatgaaaaatcttcccccaactacaggatgacaacgggacctaactcagtaactcctactgggtctcctgatacactctcactttcaaggcagataaactagaagaaggcctctcttgctctattattgtttgtagcaacaaaatttggcctcaagaaatttctaagtccaaatggtaaagggaatatagcactgcaagaacggaggacactgctgccagcgtcgcctggaaccaaaagctcgtgccaacaaggaaatgcagagaaatgtcgagaaaagcaagctactggattccaaaagtttattaagacatagctagaataatgtattttcttaaaaacaaaagagttccatatcgttcaagtcaataacagcttttctttagtgtctactacatgcaagacacttttctaagcacttagcatagattattcactcagtccctccagcaaccctttgagaaaggtactattattattctcatttgacagataaggaaactaaagcacagagttaagtaccttgcctaaagtcacacagataatattaggtccaggattcaaattggggcaggctgcccaatccagagtcaaaatcttctaggcaaatgacggtccctatcccccacatctgccaaaaaggaaataaagaactagaaaactagaaaataatgaaagcagaacttcaaagaggtcgaaaacaggaaaggaaaattactaaagaataatgaaaacaatctattattctgttacaaaatcgaataaactttagaaatgagaaactccagcctttgaaatcctctggttacccctttaaaatgtcacctattaatcgttgagagtctccacttttctctttattttggagccctcaataagagcaagaaccatgtgttttcagtggtttctaagtaactacattttgttaatctgcctctcattttggaacaaaaaatattaaagtattttttgtaactttaattatttttcagacctgtaaaagtttaaaattttgctttgaagccattgaacatacagaatatgagagaacttagaaggtattaaacagatgaacttttacagtcaactctcattaatgccattttattagcgagcactcttgttcctaagaatgagtgcttcttttctcttgagctatttcaaaatgaactagtttctttacaaaccacacaaggactgatgatcatttcagataagaggttcacagtacaaaccattgcacaggaagagaaacccttgtgcaaggtagcctgagagtccagcagacaccggcatgaaatcaacaaccaatattgacctcagcagagctttctgtagctacagtcagctatctaactatgaaaacagcaaaggatttgaaaaatacctctctaggtatttgaaatcacttactgtttgcatgtcggggtggggggaaatgtgagtaaaaatgaggctgggatgagcttaccatctaaaagacactcattggagaaatgatgactccaaaaaatctctttgattcagagatttacttttggatttatttcctttactggagcagcagctggcaatctaaaactagaaattcaaagtaatgcccaagtcattctcaatcatgccagcctgttttactgtcattgtaaggtttcagagctctattttttctcatagcgctcatctctgccagaaaatatatcattgtttatttttttattgtgtgcctccccacatataaactctataaggcagggacctcagcagtggggctctttgctgtcttcccagtgcccaccgttggcattcttgtgtttgatgaatgaatgaaaccatcgacaacttaataaatgtagttagaactttaagttaaagagaccaatcatttactaactacactagaatctacaagccccccgtgaatgttatccaccctcaagcacccgggagggtactatacactggtgctgcaggcagcaccactggttcaaatctcccccatggtgtggaatctctgaaaagtagatttgattttgtgaagcagccaaaagccattcagaatcaaatctggtgaatacatgatcgtgcccaatatatatgttggatgaaggcaaacgtgtctgcaaagtaacaggcctgattgtcttatttggttggtaaaccgattttgaaggaaattcaaaatggtttgcagtctagcaaaattgctggctcagtctcaagactctaaggtgcttatttcacaaggaataatactgagctgtggtaaaaagaatccagactagacagacaccaagatacccccaaagagctggcttgtgatattagctttgccattaagttgccctgaagcccgggacatattagttaccctctctgggcctcagttcccccatccaggaaacaaatgaacaatgtaaacttcaggatgccagtcaattctaaaatgctataattttattcttgtgaagatctggtgtatctgtttcaaaaccagtcgcaacccacttcgcctcaaacgatgcgtgcgtctataaagctctaatataatttttgcagcagattcacttcttacttgcttaggcaaatactaaaattagttttcacttcctgagcgcagcaaaagacagttaagggaggcaacccggccacgggcgcttgctcgtgcctgtacatacttccgactgcgtatcagggaactaaccgttccctctaagatcttccctcaactgttgcaaaagcagataaacctctcgtgtatgacacagaaacactggccgagagcggccatcgaggcttcgcggccagtgccgggctgcggccgctccgcagggcccaccggggatgcgacggacgcccgctccgtgcggagggccaaggcgaggaccagccgcggagcgtcgccggggaggcagggcggacgcccggcccactcaccgccccgggacggggaagcaaagtccaggcagtggctgagacgtccgcccccagctccacggccagccaacccctacccccgtcccgaccttcgcccgccgccggccggccaccttgggcggggagaacgggaggaagccggaggtacctgcctgctgctccctggcctcagccctgccccgcggggacagcgacggcgcttggacgaaacccccacccaaccctgacggtgcggcaaggccccgcgcgacccgctggcccaaggagtcccaacttcctcctcccgatcccctcaccacgggtccccgcagtgcccggctccgagccaggccagccgtgagcgcgcacccacctcgggctccgggcgccaccgccgttgccaggctgctcggctgccgggccctgctccgccccctctggggtccgccccccacggcctgcccgcccccggccaccgcccgctgcccgcctccccgtgccggttggcgggactgcatcacgtgacggggcagggggcaggaagagtgcgccgggtcgacctggggagcagctccgaagggcggggctcttcgcccgagaggctgctgggaagcccattttgaagggtccgacgcatggaggcagctgggaattgtagttcgcaatatggtgctggggatgggcggggccaagatgccaggggccatccctgtaagggaagttggactgggcgccgggcggaggcggctgggaagcgtagtcccgggacccttgtctgggtctccccatttttcttcagtaaaggggaaatccagagggaaaacttctctatacaagactttagcggatgccactaaattgagctattattgggtacacagggttggctgcgtaaagttgagatagtataagggaaaaagaaatttcactgactctggggcaggatctgcaattcacaaactcaactaacagctggggtgtccctcagctgtgccagcacctttccaagaacgcaattgagacttagtgaacggaaacatttcagtccaaaattccttctacttgttgaggtttgggtcagacaactattgatacagtaaaaagaaagggacaggaaaaagagaagaaaggcaaacttcaagaagagaattcattgtgtaatcaaataaaacaaacaatctgggccgggcgcggtggctcacgcctgtaatcctagcactttgggaggccaacgcaggcggatcacctgaggtcaggagttcgagaccagcctggacgacatggtgaaacctcgtctctactaaaaatacaaaaattatccaggcgtggtggcaggtgtctgtaataccagctgctcgggaagctgaggcaagagaatcgcttgaacccgggagggagaggttgcagtgagctgagatggcaccactgcactccagcctgtgtgacaaagcgagactgcgtgtcaaaaaaattaaaaaaagaaaagacaacctggcacatagaaaaatgagcataatattctttgtactgcataatacttatacatgagcagttcgagtaaataggatgactttatcatgacctgttttttttctcttgtatgtgttagttctccagcatctaaaaacagcattttacctgataccagtgtatatgtgtacgtgtgtttctacatagtcacacacatatacacatatattcatatatcatttatatatgcatatatatatgctttattgaagagtctagacttcttagaagagtaacaaagccatccagaatccaacccaacccactctttagccacttctcccagtgtgcctctttttgctcttcaccccaagctctggcctagttccagggaacttgatgcactgggttttttctttcctccagccctttccacttggtcctctctcctggatttgccaaactcctggaaagacagcagaatagcagctgctcctgggcccccgcacaattagaagtctcccccacccagcccttcttgttgtactgatgtcatcatttgcttacacgtctgctctgccaactcccctccccagactatgaactcctttgaatctcattcacttttgtgctgaatttcaaagcacgctcagtaaatttgcatgctagagaggctccctggtgggctgctgaataactctggattcctggtatctgtgaatcttagggcagagggatagaggaaaatggggatgggtggagggagggcagcagctgcctgggataccttgcatataataggcctggttaagtgtcccaagatgaggccaaagcttttcgatggagctgggaggagctgggggttaggaggtggggaaggtgcagagcagggatggtctcatcctaaggaggtaattcctgaagatttttccagggtccagccccagcccagccccacctctagaaagatgcaattcaaccagaaagggccagtagagaagattagcctttggcctgtgaaatggagagagtaacccctgccgtgcctgtctcacggtgtaggtgcagagatcgaatgaggcaacagatgaggaagcactttgaaaactgtaaaggttgtacactatgggctgggcgcggtggctcaggcctgtgatcccagcaccttgggaggccgaggcgggcggatcacttgaggtcaggagttcgaaaccaacctggccaacatggtgaaaccccgtctctactaaaaatacaaaaaaattagccaggcgtggtggtgggcgcctgtaatcccagctaatcgggaggctgaggcaggagaattacttgaacccgggtggtgaaggttgcagtgagctgagattgcaccactacacttcagcctgggtgacagagtgagattccatctcaaaacaaacaaacaaacaaggttgtacactatggaggggttaccgccttgcccttggtgacatcgctgtattcttgactgagcctgccctcttccaggctggggctgcactcacatttcagtgtgtgtgtgtgtgtgtgtgtgtgtgtgtgtgtgtgtgtaggaatcttcaggcttccctgcattttgcacacatacacccccccatcatgcaggaggcctgtgagaagatggctggcctccctctccagggctccaggacaatagagaggagggggcaatagatgcgacctcaggctgcttcttccacaacccttctgagtagcacagcctacacctgtttccgcccctctcccccagagtcctcccgcttttgctaaggcacaggctggagggctggaggcacctcctaccttcagaggcttcatcctgttctctgcagttgggggaggcaggctaggcagcaccaggaggagcctgcactctggatttggttggcttcatcccttacctccacctctggcctctcacctcctagataagaagcaggcccgagcgaggaaatggcctgtttcctgctacttctcccttggcctctatgctctgatctccccagtccccactcctgcctcaacttaatcctaccaggttcaatgtattgggcctgaggcaggggaaggtggaggaaagggaggggcattcttactgaggaaagagaaggctgaagaaaaagaaaattaggaatgaaaaattttaaatgtagctgtgggttaccatgctctagcagaaagcacttggaactaggaaacctgattcaggtcccagaaattctataggcaagctgttggccttgggaaagtcacttcacctctctgatcattaactgcttcctctgaaaaaaaggggttgaatgccacctcccagggtcgttgtgtccccttgaggatagatgtaaatgtgatgtatagagtgtcaaggcagcagaattcccaagttgccacggtgatcactggggagagagatgggagaggatagggggtaagcccctgtgcactgacacaaaggttccagggtttaaatcctagctcttccatttgttaggtgtgtgacttcgggcaagtacacctctccaaacctctacttcctcatctgtgaaatgggttttattcattaactccttcataagcttgttgtgaagcacatgaatgccaggtctaacttctgaatctaggagaactgcaaagcagctctgcctacctcctcctccccaaccccagtctgtatttaaaaagcagcctcagcaggatagtgcagcccctttggaaaatggtttggcagtgaattacaaaggtaaatgtacatatggccgagcaatactattcctaggtatttatccaagatatatggaaacatacgttcacaaaaagacgtgtattcaaatattcacagcagcctttcaaaaataatagtcaaaagctgggcgcggtggttcacgcctgtaatcccagcactttgggaggccgaggtgggtggatcacaaggtcaagagatcgagaccatcctggccaacatggtgaaaccccgtctctactaaaaatacaaaaaatagccagccttggtggcgtgcacctgtaatcccagctactcaggaagctgaggcaggagaatcgcttgaacccgggaggcggaggttgcactgagccgagatcgtgccactgcactccagcctggcgacagagtgagactcctctcaaaataataataataataataaaaaatagtaaaagaatgtaagcatctcaaatccccactgattaaacccatagctaagccaatggtgatatatgcacccaatggaatattactcagcaataaaaaggaagaactattgatatatgctacaacttgaatgaatctcaaaaatatcatgctaaatgaaataaactgtacacaaaatattatatactgcatgatgccatttatattacattttggaaaaggcaaaacaataatgatagaaagcagatttatggttgactggggccagaggtcagcctagaggtgggtgggggattgactccaaagaggcaagaggaaagttttgggggtgattgatagaaatgttctgtgtcttgattgttgacacgatcatgaaaccatatacaattgcccccaaatcattatactataaacatgagatgggcgaatttcactgcagataagttatacttcggtaaagctgagtttgttttttttgtttgtttgttttgagacagagttttactctgccttccaggttggagtgcagtggcacaatcttggctcactgcaacctttgccttccaggttcaagtgagtctcctgcctcagcttcccaagtagctgggattacaggtgtgcaccatcacgcccagctaatttttgtatttttagtagagacggggtttcaccatgttggccaggctggtcttgaactcctgacctcaggtgatccacctgccacagcttcccaaagtgctgggattacaggcgtgagccatcgtgcccggcccaataaagctgagatttaatcccagcactttgggaggccgaggcaagcagatcacgaggtcaggagttcaagaccagcctaaccaacgtggtgaaaccccgtctctactaaaaatacaaaaattagccaggtgtggtggcacgtgcctgtagtcccagctactcaggagactgagtcaggagaatcgcttgaacccggaaggcagaggttgcagtgagccaagatcactgcactgcactccagcctgggtgacaaagcaagactctgtctcaaaaaaaaaaaaaaaaaaaaaaaaaagctgagatttaagcatgggaagaagacaagaagacatagcctcagttaagattcctaaggctgcccagaattgtctatctctttttggttggttggtgggttggttgttttctaagaggactggggtcttgaaggggagagagtggtgatgcttgccgtgaaaataacaaggatgtgctacccagtctgttcaccatcacaatcaagaaatagaacatttctatcattcccgaagcaggagaagacagagcccagcctaatgggggcaggacagagagagcttacctggatgcaggagacctgggatctacatcccagacagagagagcattacccttgtgggccccagggatcagaagcttcccccagcttctctctgggagctgccagtgatctgcaggcacatgtgcagtggggctccaggagaccgtgaaagccaacctgtacactctgctcctgggcagacgagactgctattgcttctcactggtattttgcttccactttctcacagagctcaatgttaagttggagcctccttgaggaggccccgctggtcagcaggttctattttgccaggtgctagatggaagtttgagccaagtaatgggacatgaaaacacatacagagagaaacccaggttctttgtctcagggcttcttggacaccggggccagcacaaagggcttatggtcatgacatcacaatgtttccaagtgccagtcctgtttgcttccttcatcactaggcacatatagggtattcaccgaggactttgaagtctagtccacaggcaacaccatgacaaaattgccccagtcagatcacaaataaaactaaacccaactcacaagatcctctccttctacccccaattacaaagacttaaataagataaaaataaaagaaacctcagttgttacactaaataacttttaagaaagtaagccctatgaggaaatgtttcacgatacagtcaagtgtgttttactcaaaacaggctttttaaaaagagctttatcttttatttgaagggcctgattcatgttgaggtgtgtagtatgctacttctcaaacacagatttgtagacccaagattaaaaccaagagagaatatatgagaagggaaaaaataaaagattaaaaaaacctgaggtcgggttcagcggctcatgcctgtaatcccaacactttaggagaccaaggcaggtggatcagttgaggtcccacttgaggtttgagaccagtctggccaacatggtgaaacctcgtctccactaaaaatacaaaaattagccaggtgtggtggcaggtgcctgtaatcccagctacttgggaggctgaggcaggagaatcgcttgaacccaggaggtagaggctgccgtgagccgagattgcaccaccgcactccagcctgggtgacagagtgagactgcctcaaaaaacaaaaacaaaaacaaaactgaatgtcagcaaatatttgctgaacctgaacgaaattgtgttatttaagattaattaaaatgaataaaataggaataaacttaatcaaggaggcaaaagacttttacaatgaaaactgcaaaatattgctaaaataaattagacacaaataaatggaaagacagctgtgttcagggattagaagactcaatattgttaacatgtaaatacattccaaagtgatccacaaattcaatgtagtcgctatcaaaatctcaacagcagagatattttatttttagactagaaaaatacatcataaaattcacatgaaaatcaaggggccccaaatagccaaaacaatcttgaaaaagaagaatgaagttggagatctcacatttcctgatttcaaaaccttacaaacctatagtaatcaaaatagtgtgatactggcataaagacagacatttataccaatgggatagaataaagagaccagacagaaaccttaaaatatatggtcaaatgattttcagacaaaggtgccaagaccattcaatggggagagggcatcttttcaacaaatgctgttgggaaaaccagatatccacatgcaaaagaatgaagttagaccctaaccatacaccatatacaaaaattaactggaaatggatgaaagatccaaatgtaagagctaaaactataaaactttcagcagaaaacacaggggaaagcttcttgacaggatttggcaatcattttttagctatgacaccaaaagcacagcaacaaatgtaaagtagataaatgaagtacatcaaaatttaaaacttctgtgcgtcaaaagaaacaaaagagtgaaaatgcaacctaaagaatgtaagaaaatatttgcaaatcacatatctgatgaaggattaatatccagaatatataaagaaccctggctggtgtggtggctcacgcctgtaatcccagcactttgggagaccgaggcgggcggatcacgaggccaggagatcgagaccatcctggctaacacggtgaaactccgtctctactaaaaatacaaaaaattagccgggtgtggtggcgggtgcctgtagtcccagctactcgggagggtgaggcaggagaatggcgtgaacccgggaggcggagcttgccatgagctgagatcacgccactgtcctccagcctgggcgacagatcgagactcagtctcaaaaaaaaaaaaaaaagaacccctacaagtcaacaacaaaaaactccattaaaatagggaaatgcaaatcaaaaccgcaatgagatatcagctcacacccattaggatagctactatttttaaaaaacacaagccaggtgtgatggctcatacctgtaaacccagcattttgggaggccaagccgggagaattgcttgggcccaggagttcaagaccagcctgggcaacataaagaaacccctgtctctacaaaatattcaaaaaattagccaggtgtggtggtacatgcctgtagtcctagctacacaggaggttgaggctagaggactgtttgaaactgagaggtcaaggctgcagtgagccatgatggcaccactgcactccagcctagacaacaaagcatgactttgtcaaaaaaaaaaaaaaatacaagtaaaaccccacagaaaatagcaaatatttatgagcatgtggagaaattggaagcctcgtgcattgctggtggtaatgtaaagtggtgcatctgctgtggaacacagtatgatggctcctcaaaatattaaatacagaattaccataggatccagcaattccccttttgggtatatacccaccagaatagaaagcagggtcataaagagatgtttgtacacccatgttcatagcagcatcattcaggatagccaaaagctggaggcaatgcaagtgttcattgatgatcaaaggagagagatagataaacaaaatttggcatatacatacaatggaatattagtcttaaaaaggaggaaaattctgacacatgctacaacatagataaaccttggggacatcatgttaaatgaaataagccagtcaaaaaggcaaatacaggctgggaacagtagctcacacctgtaatcccagcactttgggaagctgaggagggcagatcacctgaggtcaggagtccaagaccagcctgaccaatgtgatgaaaccccatctctactaaaataacaacaacaaaattagctgggcatggtggcgcacgcccgtaatcccagctactcgggaggccgaggccggagaattgcttgaacccgggaggtggaggttgcagcgcaccaagattgcgccactgccctccagcctgggtgacagagcgtgactccgtctcaaaattaaaaaaaaaaaaaaaggcaaatactgtaagatatgaggtccctagagtagtcaaattcatagaggcagacagtagaatgatgggggccaggggctgggggaagggagaaaaaaggagttattgtttagtgggtatagcgtttcagttttgcaggatgagagagttctggagattggtttcacaacaatgtgaatgtacctaacactattgaactgtatgctcaaaaatgattaagatggtaattttatcatgttatcataattttatcataaaattttatgtcatatttattttaccaccattgaaaaaaattaattaagccctcacaagtagcttgagcttaggggaccaaaaactcagactcattgataacattctctgtggttcatctcagacgtgattgtacctttcaaggtcagcttccacccaggacaggaggtctcatgtcctgcttcagaaacaaagcctcccacagggagccagaagtaactaagagcccaagtcccaggcgactagaaggatgaggaagccagaatatgtgtcctttccaaaataaatactacccctctttgtttcactgccaaaaacccatgagagttgtgaaggcggtgggagggggatcttttcccagaatatcttcccagacccctcctctccactcaggagagcaaacaccagagagaaggcaggcggggctgtgtaggggagcaggacgcgatggaatcgccttagaaactgccttctaaggatcccactcgtcaggaggtaggcagctgaggtgcagttctttgacagaatgcttcagatggagtctaacaaaggcacgccctctccagttagagcctccagggatcacttcaaaaaggtcattgaccaatggatgggggaagtgcactcccccactccccaggaagcctgttaaccctattaatcttcaggtgagggcctccgggggtagctatttgtgaacagaatggagtctcagccacctccccaatcccctacccctacccctgtcaggcccctaggaagtaaaaatgtagcatttccagcaggagtatttctagtgacagctggagaccacccacctgcccttcctcataccatgagggctcatgggaacgaagccgaagcgctagggagtgagagcattggcaactgcccagactaagagcctgggttctcagcgctgcacatggaaacctacctgtttaggctaaccgtccctcaaacccccaagccctcatcccccaacacctgccccccaacatagaacattgtgcatgttcttgtttaatggcttgagatatgatttactcactataaaattcacccacataaagtgtacaattaaatggtttttagtatattcagagctctacaaccatcactgctatctatgtccagaatatcgcatcatccccaaggaaaaccgagaaccattagcagtcgttcgccatttctccttctccactatcccttggcaatcactttctctatgaatttgcatactctgaaaatttcatataaatgaaatcatagaatatgtggccttttatgtctggcttctttcacttagcatcatgtttttgaggttcatccattttgtagcatgaataactgcttcattcctttttatggctgaataatatttcttttttatgtttaccagtttattataaaggatattacaaaggatacagatgaagagatacatagggtgaggtatgggggaaaggacatggagcttctatgccctccctgggaacaccacccttcaggaacctccacatgttcagctatctggaagccccctgaacccagtcctttggtttttatggaagcttcatgatgtcagcattccttcccccaggaccctctctggagaggatcttaagacacacaattggaaaggctagggaagattagagtcttgccttggagcaggtgagaggggggcaggagaaggtcccagagattctgtttcctgaggcctgctcctgaggcctaacaaacccaacattttaatcaatgaccattacaagggctatgggagtcatgagccaggaatcctggatgaaaaccaatagatatcataacactacaagccataccctggtttttgaccacggatcccttacaaaaaacgaatatgcacaattattaataagtagtccagtccatcatattgtatgaatatctcccagggtgagggcactcaggttagtagaatttctttcagtcttgtcaggttccaaaactggtcttagcaaacatacagctttagcctttcaggcacctggaataattgagctaagagacgatgtcgtctcttgctctgatattcctttgagttgttagtgcaatactggatttcccacaatttataacccgcttactcatttatttacccttggctattattccttcttttctccatttgtcatttatttttacccaaacttttccacctttggaagggacactaagtttggccactgtgctggtccagattgctggtagcgatactagtctagtaggtggttcctcctccatccatttccatacatacagggtagggttacataggttccaaactagcaagtatggtggaataatatttcattggaatatttcctaccatcttttgtttattcattcatctgttgatggacatttgggtagtttccaccttttggctcttatgaataatgcagttatgaacatttctgtataactttttgtgcagacatatgttttcatttctcttgggtacatcataaggagtggaattactaagtcatagcgtagcttcatgtttaacatttggaggaactgccagactgttttccacagaggctgcacaattttacatttccaccagcaacgtatgaaggttccactgtctacatgtcctcaccaacacttgttattgaccatcatttgtattatagtgtgacatggtacctcattatagttttgatttgcatatcccaataagtaataaagttgaacatatttttatttgcttactggtcatttatgtgtatatcatctttgaagaaatgtctactcaactattttgcctgttttttttttttaaactgggtaattagtttttctattattaagttgtaataattcttttttttttttgagacggagttttgctctcgtttcgttgcccaggctagagtgtagtggtgcaatctcggctcactgcaacctccaccttccagtttcaagagattctcctgcctcagcctcccaagtagctgggattacagatgcccaccaccacacccagctaatttttttgtatttttagtagagacggggtttcaccatgttggtcaggctggtcttgaactgctgacctcttgatccacccaccttggcctcccaaagtgctgggattacaggcgtgagccaccgtgcccggcgagaattctttatctattttgaatacaactccattatcaactatatacaatttgcaaaaattttctcccattctgtgcattctattttcactttttagttagggtctgttgaaacatataagtttctcattttgaggaagtccaatttatctgttttctttctttctttctttctttctttttttgagacggagttttgctgtgttgcccaggctggagtgcagtggcgtgatctcggctcaatgcaagctccgcctcctgggttcacaccagcctcctgagtagctgggactacagctgcccgccaccatgcccagcttcttttttttttttttttgtatttttagtagagatgggggtttgacttgttagccaggatggtctcgatctcctgacctcttgatcctcccacctcggcctcccaaagtgctgggattacaggcatgagccaccgcacccagccaatttatctgttttcttatttcatcggttgtgtttttggtgccatatcttaagaaaccatcattaaatccaaagtcatgaagatttaccactatgttttcttctgggagttttatagttttagttagctcttacctataggtctataatccactttgaattaatgttttaatatgatgtgaggtaggggtccaacttcataattctgtacatggatacccaattgtttcagcactagtttttgaaaaaactattttttctcccattgaattgtcttggcacctttgtcaaaatctgaccataaatgtgagggcttatttccagaccctcaattctattccattgatctgtctatgctaatgccagtaccacacttctctctctctgtcttttctctccaggttcattgggaaggccaccttgggtgactcctaatacatctagtgctttcaaggtcttcaagcactctaaattcctcttcttatctggcccacaaaacagccttagaagacaaatacataggtgaccatccctcttttgcagatgaggaaactgagtctcagggaggctgtgagtatctcaaggtaattgtgctggtaggtggtggaattgagaccagaatcccagctttcacctgtaaaactaagctccttcctggacagcacactttgctctttaaaaggtacaactacatacatacacaatgggatactattcagccttaaaaaggaaggaaattctgtcatttgcaacaacatgcatgaacctgcagaacatcatgttacgtgaaataagccaggcacagagagccatatactgcatgatctcactcgtatgtagaatctaaaaaagttgaactcagagaagcagagagtagaatggtggttaccagggactgggtgtagagggctggggagatgttggtcaaaaaaagtcacaaaccaaaagtttttaaaaaggtatgactttgaagacatgctctctgactttttaaataaaagtagctcccagggcttttttcctgtaccctagctagttcataaaggcattgtgagacttaatgtagctcacataagtgtaaatctttcatagactgtcaaggattaaatacacgtgaggagttattagttgtgcatttctataacaactcttccttgaaatcatctggatcagaggtggaagtggcccatttcctatacctccacccatactgcagctatcattggacagcaaactacagtgactattatcactttgccatccaggtggaagagtcactatgagacccactattgtcccagttgtatttattgttcaggaagcccccaatatcacatgatatcccttcagggatggaggtaaatatagtatctttttttgactcatagtattgttcagctagtgtgttacatgcttgaattaaattaaactaaacattacctcaataaaccaggattgagtacctctgatgttctaggcacaggattatgcactagaggggacacagagaggattaagacacagccaagataggcaggcaatgacagctttacagggaagatgtttcttcattcaaatttggcaagtttttattgtgtgccaggacacaaacatggtccccactaccactagttaggagcaattaatggattaccataatggataccaactcccacaaatagctaatcacagcctgggctacagaccatgaagggtgttatgagagcagtgaccagggaacatccctgaagaaggtacattggagttcacatggcatatagtgatacgtgctataggctggagatgtgcaaattgccacggtagttcaggagatgaactgatgaaatcttgggtgaggtagggtatgtttcatagcaacagtgatgtttggaacgggctttgatcaatgaccaggtagaatacgaaaggaggatcaccctgagctggagttagcacagacacaagctagggtgaccacagaacacatggtccaaaccaggagacctttgaaagctggcactattcactatgatgcagaaacaacaggcataagctggggctgtccctgtaaacctggacatgtgacgtccctagcaaaagcacaaaatggtgagcgtaatgacacccaagctgttagaatgtagaattgggagtgggagggactgggttggaaagtgagtacatgagtttgctagagctgccataacaagaaccacacactgagtggcttaagccacagaaattggccctcttctggagactagaagttggaaatcacgatgttggcaaggccacgctcccttggaaggcactaggctaagatgtgttcccggcctctctcctagtttctggtagttccctggcttgtgtcagtataactcctatcctaacatggtggtctccttatgtgggtgtctatctctgggttcaaatttcctctttctatgaggaaaccattcatattggattagggttcaccccagtgacttcatctgaacttgatcatctgaaaagaccctttttccaaataaggtcacattcacaaacactggggttaggacttcaacatcttttgggggaacaaaattcaacccttaataatgaggcagaagacgattatagctgtgaaagaatgccacgctagtctagtctgtcctgaaaatcatggggaactgtgaccagtttgtgagctggagtacagtttagtctgtttcaaaacagtaaccctggcagcccagtcctttaatttggtccaattggagatagacaatgcttttttggcttttaaaattctccccccagttataaaaataccttctttagtattgcacttccttttgggaatcaaggaaggcaaaatatgaatcctgaaaacaatggaatcgttttaatcgaaaggttattttctcactctcaaatcatttttactaccctagcttgcaagataacaattgctttctctattagaatacacagtgtaggatgactttcagtacatgcttgtggggtggaatacaaagttgtttaatcttatgggttaactttaggtatggttgtcaatgctttgctgttgtgtgtgatgtatcatcagcacacaaaaatctcatttgcctttgattcctgacctccaacaggggtttccacatggcttcatggaactctagggtccaatggtgcttccagaagtgccctagaactgcctggggggtggagagggcagaccagagaagctgagcttgggctgcttttacacttgtcagatttgtctgaaaactgccttgcactctttttgtaaaaagttgggaaaacctgggactttgtccccacagccagcttctctcggcctaagggcaaacccgtttgatcattaaatggagtccacggtattccttcatccagaaactattgagcacctactgcatacctgacactgttcaagagagatgacagtgtacaggcatgtgtttctgtggttacctctttggaggggaatttggtgacagtggaagccattatggagcacatttttctcaaccaatgatatcctaataggatctaagaaaggccatttctggaatgcctgcataggcacagaatttagttaggagcgtgtagtgggttgaataacgcccacccccacccccctctgacccaaattaacgtccatagagaacctcaggatgtggccttatttggaaatagggtctttgcagatgaaatgagttaaggatctcgaggtgaaatcatcctggatttagggtgggccctgcatccaaagacatgtgcgtgtgtgtgtgtgtgtgtttgtgttttgtttttgagacagagtctctctctgttgcccaggccagagtgcagtggcacgatctcggcggactgcaacctctgcctcgcaggttcaagcaattctcctgcctcagccttccaagtagctgggactacaagcgcttgccaccatgcccggctaatttttttgcattttaattttaacacggagtttcactgtgttagccaggatggtctcgatctcctgacctcgtgatccatccacctcggcttcccaaagtgctgggattacaggtgtgagccactgtgcccagcctggtgtgttcttataagaaggggagaggacacagagacacaaagagagcagagagccatgtgaagatggaggcagaggttgaagtgatgtggccacagaccaaggaacacctggggctaccagaagctggaagcagcaaggaaggatcctcccctagggccctcagagagcatggccctgccatcaccatgattttggacttccaagcctctagacttatgagacaaaacatttctgatgttttaagccatggagtttgtggtacaatactttgttctggcagaaggggagggacagaccacatccatttccacatgcttcctcacagtcttgctggagctgggacacttgctgctttcctgcgtcctcatcctcgtcctctttctcaccagctcagcaagggctggctgtgagctccagaatgctattgggagaagtctagacaagggagggccaagtctggaccacttctgctcccctcacttcttttctcaaggtcaacatatcccacgcacagtgattgcagtagcagccctggcccttctgcatggcccagcctaaccagcacaggctggccagcacaacctctgtggacaaacattaaccgaagaaaaccctgctaccctccccgacatgccatccatcctgtaccctctatctacggcctcccacaggctgataggaagtggggcacagttaagcccatgccggctgggtcttggttgtttcaactctgggagctgttatcgggaaactccttttgagaaatctgcctcagtgaagggtgaagagtggcaattgtgtgaacaaaacaccccaagcttgactcccacacctggctgtctcagggccatctacttactcccatcctaccaagagtgcctgtttctcgagcatggaacttatcttattttcccatatcatgatgaatcctcacaactgcccttcgagggaaggatgattatgatgcccacttcagagaggaggacacagaagttcacagatgtttagggatcttcccaaagtcacatgtctcttaagtgacccagagatttcaacccgaggttgctggactccagcccctctgcgtttgctccttgccctgctgcaccccttgtttgcagatgtgctttgcagagggtgagcttcagccacagccacatcacccctaaccatattcagcagctgcctctttttttttttgtttttttttttttttcattcattgccaggacctgcccatgggctgcctcctaagctctcttcttcctatagtcagtttatggagctaaaaagaaggcactggctcaaccacccttgggggtgcctgtttcaggagagatctcgaccttttaaataatttccccaaatacctctaacttataaaaaagcaaacaaaagcattgctagtttgaagtttacttcctatttacagtggttagcatatttattttaggccaaattaagctctgattttacatataacccgcatccaccatatatcatccaatgatgagccccgatgaccccttctctccacttttggtgattttgggagtttagacagctgttgcgcctggcataccgtcaagctgagtatgggaaaagtgcaggcaactgtctttcagacttggcttcccagtttgcactacaatcccacgagggcagagcttgtagggaaagcctgctaggtttccccaggtatcctcagacagaaaggaatgtgtaatgaggcacaaatcctaagagtgctacccagaggaaacttggcctcctctgacagcagttcctggggccacacgtgatcccagggagcccccaagttgctctcaggactgtaccagttcaggctcccctcccctacttgacctcaaaccaggcttgaactccgcccttcctggctctctccctttgcactcaaggacttcactgcccacccccatggggaagcagacaggcgggcaccaccttcccaagctgggtgagagggacaaactccccaacctccctgagctctcagggaattgtccttggtgggtaggtcctaagccccttttagaagtcaacttcaagaagcctctgggcctcccgcctttattccttgggtaggacacatcctacttcctctcttcctcccctcctctgctgtaggctcccctcctctatcatgcaggcccacccctgcagcagggtcagcgagcaatagcctggactccagttcaaggctgcagggctccaggacaccttttcatttgaggggagcaccagactgggcactgtagtcattggggcccctgctcttcctagacaagttcacctcggcccattcccacacctcaccttcaaaagttgccagaattggaaaataaaaatacaggtcactcacttacatttgaatgtcatgtaaacaatgaattttgttgtataagtatgtcccatgtaatatttgaaatatacttacattaaaaatgatgtgtgtgtggtgagtgtgtgtgtctgaaattcaaatgtaattggcaatcctcctgccacccgcccagcctaatgagtcacaaccacactggtgttttcacaggacagcaagtcaagccaccagcctaggctggagacatgataccaaccgtggtgtcagaaaacaagtttgagctttcctacccttctcagtaagtggctctgctcttgctctctgcagaacacccagccatgctcagactgcattgtcctctgtgcccagagtaataccttaggcacagcccttactagcttccagtataattatagggtttcacatctactgggctttgagcttcttgagggctaggactggtgctgatggatctcctctctcctctccttacagtgcccagcagaattcaggacccagggtggggagagctcagaaatgacttggtgagagaacacttgcatgaatgaatgaatgaatgaatgcccctgattgcatctaaggggcggtcttgtgaaaggccacacctgggatgtctggctttatcctctagaatggtgggtctctaagggcagggatcttacctgttttgttccctgctccgtctctagcacctaacaccttgctgatacccagtaggtgctcagtaaacacatattgcatgaatcagcagctgtgttcacagttgactgggccgatccgtctatcaacctgtttcctagcttggctctctttccccacctccattaacagttcagagatggcggctcctcctcttccacagaggcattaggctgagtggacagcgactaagggcagggaggacagcaggtctcactctctgtcgaaggagacttcaaggctggctgagggaaaggaaaaagaaggctcacttagaagggaagcgtgcagtgagcaaggccaggtcgtgccaggcaggaaaggggcaattggaagggcagacacgggtgctggggaagtggccgaagcccaggccggcttttctgagtccgagtcgtaaagcggagaagactcgcaccagagcaggcggctggacggcggcgatttgcaagaccgggcacagcagcggctctgtagccggctgggaccggcggccgcgcacgtgaccggccgggccaatggagaggcagcgaggtccgcggtcaagggcaccgagtggtgcggagactcgcgcgcggtcggaacaggccgagggcttaggggacctctgccaaccctcgggtgtggaggaaggggcgtgggggctgccgagcgaagcacccgggccctgccccgctactggagcctgcctggcacaaactccagcctgggagggccagagctttccgttggccgctgcgtgggtgggacccgggagggtggtgactgccagtaactcggctggggctccccatcgagccaagtccggagggaacaggacactccctcagaagctggcctgcccaggggaattctgggatgggaacctgctaccctcaggttgccaccggccaaggccctgcatgcgctctcttttgctgacaagccataagctccaaagcccaccctcgcgttgtgctgggggaggggcagcttctgagaaccgcgtctgccctgttccgcatccctagagcccgaaagagtggcgggaggggtagggatggttagtgagggggccccaataccgttcgctatcaatacagggttcatcaaccccacactcaccccatgcccagcataggacctggcagctagcaggtgcttaggaagtgcttgttgctgaagaaacaaatggatgaatgaatgaaatctggcagttgtggctgggggtgaagacttgcttcttgggtgacacttcctaactgtgatgtctccatctgaggagctgtgacaattctccagggcagggccatgcgagaggaagctgttgtcttccgctgccaagcgtagctggggctcaagccaaataacgacagtgcccactttgggaggatgtcataagtttgaacaacgtagtaaaacaaacctcctttttgtcccaaagtccactccttcacacctcgctgccttagagggcctccagctctgcagagccagctgtgcatgcctccgcctttaagaagcctcccgcccccttccaccaaacacgagggacccctccttccccagggttatccccagcacattcactgtgttgtggttccaccctctgagcacttcctgtctccttgagtctgagaaacctcagttgaaatctacctcccttttcctagcttgtttctgagcctctttatctgcatttataaaacaggatgatcataatagcactaggattattatgaggcctgaacacaaggactcctgtaaagtgtctggcacagaagcagtccttggcaaatagcagtttttgagctcctggaggataggggcagtgccttctttgcttaccaccgtctctctctctctctccctctctctctctctctctctctctctctcacaccaagcagacagcctggtgtgcagtaggtgctccacaaaaatgtgttgggtgcagaccgcttgaagccaggactttgagaccagcctggccaacatggcaaaacaccatctctaccaaaaatacaaaaagtagcagggcacagtggctcccgcctgtagtcccagctactcaggatgctgaggcaggagaatggcttgaacctgggaggccgaagttgcagtgatccgagatcatgcccctgcactccagcctgagcgacagagcaggacttggtcacacacacacacacaaaagtgttgtgtgagctattgctgcactgtcttgcttggccaggagtggttcccaaactgggcacagctgagcttgcaggcagcttctggggctgggggagggaagcagaggctgacagtctggggtagtggttcaaaaagtacccacccccgagaccggatgcttttagaattgggtgtgcagagggatcaactcccttcacctgcctccatagcccagcacaggtaggatgcagtgtacttggctgcctcccaatttctgtgccatccacaagatggctgcctctggaggcgtgggcagagctggggttggagctcaggcaggctttatgccccctgcaatttgcctagtaacccagatttgtggccaggcgctggtctaactcctgcagggtttggctggagctagggtttcccagttttagtcaataaagatacaggatgcccagttaaatttgaatgtcagataaacaacaaatcttttgtagtagaagtatgttccatgcgatctttggaacatacttatactatgaaattattcgttgtttgtctgaaaaacaaatgtaacagggctccctgcattttctctggcaagcgtagctggagcttgtccagctgctgtggattgtaagggaatcaaccttggagggtggagtgggagggaactgctcccaccaaaagtactttgaattgatatcagaacaatggcatgggctgttttgtttttctttgcttagaaaaagagcattccatgtcactcaaaagaaaatagaacggtgaatttcagctctctgccttgctccattgatgttgacccagaacatgccttgattctgaaagggatattgactgttagacaagtggctctttcattttctcggcaactctccttctagtggttggtgcccactaccctgtgtcccatttggaatacacttgggataggatgcagggtggccatttgcctctccagagggtgctgttctgctgggctattcagatgctccaagtacaaagtggccttagctgtgaactagggaacagatatatataaataaagaagaagagttctatttctcaatttcatttttccatgctatacaacctctaattctcacaacgattctgacaaggcatgttattattcccattttacagatgggaaaactgaggcccagacaaggaaaagctttgtgcaaggtcatacagcaagtgagcggagaggccatggttcaaactccattctctctattctctgaacttagtgcctagaagttggcctcaaatccagtttgaaagcacatagggaagaatccatacattaattaacgtaaccttcaatcacatctcctgatgccagagagatgtttctgaagcgcagatctgaacatgtcctgcccctgcttaaaactttcctgggcctccccattgccttctggatgaaattcaagctccctagcttgcatttcagaacatttgcagatcccacgtctcttccaccgtctctagcctcatcttccgccacttgcccaacgctcgctccccctccacacctctctcccgtcacctcaccagccagggcctgcattctggagtggagaagggagtgggcctcggtgagccaggccctggagtccagaggggccagggagacatgagcctactgtgcgacactatcagtcactctgagacatggcccaagtcccaggacaacagaccaagttcctgaagccacagcagctgtgctccaggtctgccctgagctgctctcgatgggctgggtggaagcctcctggttttggctttacagcatctcaaagtcgccacctaggccctgtaagatgtctgacaatccagtcccgggagcctctcttggcccattgtctcagcttgcaatgcacctatgcctgctttcaaaattttaaacaattaggaaagttattagctcatgagacaggaagtccaaagatagggctggcccaactctatctccaagcgcccagattctttctgcttctctttgttgccatccatggcattcatctgaaggctgattccccttgtgtccctaacatgactgtctatagcgattctggctgtacaactccttgttggaattcactgggtgagagagtcagtaaagatcttgatgggtctgcctagttcacctgctcacccctggatcagtgactgtcatggaaggaaacaccacatgctgtttggcttaaagctaggttcccaagtttcatccggagctgtgtgtcgccaggctccatccctgcccacgcctccaggctgagtcaggtagctccttctcaaggctccctcaacctccgtgcttcactctgtcacagcactgtgtagccactgtgtggtcattgaggtttttactgtcagttctgagaggacaggggttgtcttgggtcttctgtagccccagggattgtcccagaagggctgctttgtggtatttgttaaatgaaggggagtggaggagtggttggttggcgcaacgtctgaatggtgtacgcatggggatgagaatgacatggggtgtggatgaggaaggccatcaatacgcatgggttcccatgtgcaggggcccatggaagtgggtgtgcctgtgtgtgagcatcgaagtagcacaaagcctgagctgtttccccccaggggaaagcccgggccagcagccacagggagcctgggctgaccagaggcaggcctttgtggcttctttaagtagctgggcccgctcaggtctgacccatcctccctccctcacactggcctttcttagccagtgacttcactcctcctttgcctgcctgtccttgtctcaccttctgggtttgacacacaccggtgccctctgtctggttattaataatgcttgtgggtcatcctaatacagcctgtttccagagcactttctcagcaccaggcctgggctagggctgcaccaggcactggatctcctctcaaccacacagtgacataggaatctccccaggtcccagaggggcactggttgggggttcaaacagaggggacttgcctaggggttatgagtcccttgttgtgtcaggagaggcaggatcttagttacggcccaagtcagggcgcagtgcagtgcaaaagcagcggatctgtctttcaggggaaattttaggtgaagtccctgtagaaaaatggatcacaatgaacttgctctggttaggtgttggggacaggatccctgcctcctcacttccccatctgctcaggggactctgaggctcagcctaggtttgaattccagctctgctacttagtagcttggggcccggacaagttaccttagctttctaagcctcagttatctcatctatagtggtggctggggaggagtgagagtcctcacctcaaaggattctactgagcatttcgtgggatgctgaggggtagatgggcccatgcatatgaagcgcttggcagttacctggcaccagttatcattcactgggctgcccagatacaacttcctacctcccaaggacccctccagaatgcgagcccactctttctataagtcttcctgtcatctcccaacctgccctttatcacccagatttcctccccatccatccatccatctgtccttccatccatccatccatccatccatccatccatccatccatccatccacatactcattcatttatttgtgtgacaaatatcttttgggcacctactatgtgccaggcgctaagctagctgggtactggagacaaaggccaaggtctctgccctcagtgcagctatgatctctcagtgtcaggagagctaacctagggaaacgtatccccccatcacacccacaaccctcacctccagtagtacaggataaatccattcacatgtccccagtggcccattaaacagaggactggaacccagcgcccaaggccactacatttctgcaggggaggacctggggggtttcctggtgcagcttggagaaggcaaatgatgtgataccagcatccagcccccagcctttgccaaacttttcccagggttctgctggaaccctcagccattcggtcatgaaatgggcacatacgtcagacagtccggagcccaggaggccctcttggggccactgtgggtaaactctttggggcttgactgagccagctggagaacacttccctctaccataaacctaaaattcctctgaaatcacaatcactgtggccgaggggaagagaacatttgctttataggatcccacgtatacacaagctactttctagggacacagcctgtggcctcaagtgattttctgggcactctgtaatttgccaccctcctctgccatgggcatgtgcatgtgcatggaggtgaggagaatgccccaccaatgagacaaccatggatcactcagcctgggccaagggggccctgccttgacaaacggggctgatgtgctcttgggtgctaaccctagtatactaggcctgccagccttgtggcggtgcttggggatccttagctaaaaaggctagtggcttcttggatcgttgaaagggcagcccatgctaggagtgtgtgctgccacaggcttaggttggaatgctcttccttccccagactcatgggggtcttccaggcttatcatagatatcacttcctccaggagtgacacctcctctgtgccctctcctctggctaggcttggcttccttccttgtggtcatagccccctgagtttgcctgggccacagcacttaccatcctgtactataacatcttttcctcccacgaccctgtgaccacttcttgttgtcacttacaagtacctggcatacagtaaatactcttgagaatgagcaagttagtgatgatcctctatcaagagataaggccaggagagataagtcatgccaatcccaccgagtgcctctggtccccaggcacggctctggcatcccaagtggtggtaggcaggtaggcagggctcattgccaggcattggaaacatgtggcggagctggaccactgcctggcagaggtttgcaaggccccgagccctcacaggggtagggagcacacacagggcctggtaagggaggcgtagggcctgctggatgaacaggtgccagatgtagggctgggggaggggggcagtgagcagtgatgctcttggcttaagtcctaagggcagtatgctggaagcaattcctgctcccttcgaatagggaagtgacaggacttgtcagtgttcaatggcagcatggtagaatgccaggggtctccagctgggagccttacagcctatgacccattcccctggagggtcaattttgctctaaaatgcggcagggcagggagggttaatttaactggtaggtaacataaatattactttcttatatttaaacaaacatggatgtattatgttttagaatgcaaacttcactgaatcttggagctatagcataaggtgtcaaaacggcaactttgggctgtgcccccagactgcccccagggcctgcatttcattctcttcagttgttagggagacccagcatgttgggggtgggaaaaggtggcctttatcatcagatggactcagattcccatcccacctccccctgcagcttgacttcaccactgatgagatcgttgggcccttgaatgggtgattctaattcttagggattgtgtgagtccgttcttgcattgctataaagaaatacctgaggctgggtaatttataaagaaaagaggtttaattggctagaggttctgcaggcttacaggaagcacagcgccagcatctgcctctggtgaagacctcaggaagcctacaatcatggcagaaggcaaaaagggagcaggcacatcatatgatgatagcaggagcaacagagagagcagggaagtgccacatacacttaaacaaccagatctcccctgaactcattcatcaccaaggggatggcgctagccattcatgaggaatccgcctccatgatccaaacaccttccactaggtcccaccttcaacactggggattgattacatttcaacatgagatttggaggagaaaaatatcaaaactatatcacggatgatgacgcctgccttagagataggcatgaggactaatgaaggaaagtaggccctgtacagccccctgcctggggttacaaacctgacaacctcgccaaatggagacgggggagttggtgtgaccccacccccgacatgggtgtggagtggaagtgcctgctgttctggacctgccactttgagtgccttgccctggcttcttcctttgtaggctagtgggggtgtgggcattcccaagccttgtggacccctaagtggaatcattagcctttcccaccactcaggaaagggagaccaactcctacactctgtctgctctaccaggcactgggctgagcactttaccaccataatttcctttcattttccttcccagagaagtctggggtcctctggggtattggggaggagaaaaggcaaggagttgagaacccaggaaggctctaacttggccactgagtgcccttggagaagcaccttcctcctctcctccatggccagctcagcttctagatcagccttccctggtctggcctctccatgacctcaagagatagagtggcttagcctctctgcccactctgtgcaattggccaagctatggaggaagggtgtcttagtttgctccagttgcctcacaaagtaccacaaagagggactcaaacaacagaaatggactgtttcacacacagttctggaagctggaagtctgagattaaggtgtcagcagggtaggttccttctgagtgttgtgaggcagaatctgttccgggcccctcatttagtttctgggagtttgctaacaatctttggcattgttccttggcttatagaagcatcaccctaatctctgccttcatcttcacatggtgttctccctgtgtctccgtctctgtgtccaaatgtccccttcttttttttctttttttgagatggagtctcagtctgtcacccaggctagagtgtagtggcatgatcttggctcactacaacctctgcctcctgggttcaagcgattctcctgcctcagcctcctgagtagctgggactacagatgcccaccaccacaccaggctaatttttgtatttttagtagagatggggtttcaccatgttggccaggctggtcttgaacttctgacctcagctgatctgcccgcctcggcctcccaaagtgctgggatacaggtgtgagccaccgtgcccggcccaaatgttcccttcttgttaggaccctagtcagattggagtaggacctacccattctagtatgaccttattctaacagaactcattccatctgcaacaaccccatctccaaataacgtcaccctctgaggtactgacaatgaggacttcagcatatgaactttgtggggacataattcaacccataacagaggtagaatggaaattcaagttcatctgatgccaaaggccactttctattccaacatgctggggcttctcaaattttgccagagcctgcctaataacagaagagaacgagatacagtctcctacttgcatccactagaggtgatggggagagggattttgagtgactgtctccagtattacttccccaggacatgtttgctcaaggccacctacggctgtttcacatgccttggtcccctgtttcctgtaagcttcctgcccctatcctgtggccaagtccaaggtaacttcgaacttccagatttgttctagagtcctgatcttgttattccgggctttcttgcagcaggaatccttggagcccccatgcagaaaggaccttcatttgtctactaccaagagccctagagtgcctttagtggcacacaggttcccttcttatgggcatccttactgcacttcattgtcccacccatttgtggttttccctagactgaagaagatctcattctgggtttgttggcagcctccagattgcgtctcgaagagtgattgctttgggaccatgtggagcctcatttgcagcggccacatcactcagagcctggggtttcttttattgctatttctgcatgctacccacgtgcttattttagactcctctctggaaagtctgctcgcatttaattcctttcagccacactttcacactgttctaacctatttatatttaacagtttgagcactgcagtgccttgattagaataatcagttctgtatcagaaacagcctccccaggaatgtagaatccagccaagtgcccagatgccgaggaaacagccctctctttccagctacaccctcctagacctcaggagagctgtgtgtggtgggttctccaatccccaggtcctgccatcatgaaaaatgaaatcaatcttgattggattattctcaaaggatttatggaaagggggatgcccctcctttacaacagcttcaggatttaagtttggcagcacttgtaatgatctgtaggcattaggtgcatttcaggaccaagagagactgtgtgctaataagatgctaatacctaacactcattgagaactgaccacgtggcaggcactgggccagctgctttccctatagtggagtatttcacttgttccttgcagccaccctctggggcagatcttattattacgcccagtttaccaatgagtagattggggctcagtggaagtaaatcgctttgagatcatgtagttggtaagtggcagcagaaggatttgaatccatagagtctggctccagaactccaaaacagaaccattctctcgaactaagtgttgccactaagatcttgagagtttaatcaaacctcttcatctctaagtggggaaactgatgcatgggggcgtggaggaggaaggaacctgcccaagttcataaagcaagctggtcatataggctagcacaatttcacaagttaccatggccagggcttaggggtgggagcagtgaagggtctttgtggctagtatggtcagggactctacctctttggtggaggtccatcctgccaattggcttctcgggcctgtggcagtgagggaggtccttgctactgcccctccaaagacgcctgcagtgacaccacagtcagatatggtggcatcagagtgggggtggggggggacagcaagaacgtggcctgtggcagaagtcagcttctggccagccttggctaactgtaccttctcctcaccaccagcaggggaccatctgtctccttccagccatgggcaaattatcatctttctcaagtcctctcgggtctcatttccaactgaagcctgatttccttatggtcacagcaggagttctcaacatcctggggctctaactcaacgacaagacactgggccttctcttcacaccctgggaagcctggactgggacaagggaaagatgagggagcctcctgaagttttcataccgggagccatcagaaagggtacatgtggtgagcctctgctcttacagaacacaggctttgaaaaagacttcacagaggattcatgctgcccctgcccctaggaagcccctcttcagctcctctgccaagaggccatctctccttaatctccgttttattgtggtaaagtgtacataaccgaaatctaccatcataaccattttaaggtgtacaattcagcagcatttaggacattcacaacattgggcaaccatcaccattatctagtcccagaacatttttgttaccaaaagagaagaccccatacccattagcagtcacttcctatatcttagcccctaatcccctggcaactctctctgtggctttgtctgttctggatatttcttataaatggaatcaaataaatgtggccttttgtgactggcttccttcacttagcaaaatgtttgcgtggttcatacacgttgtagcacatactagtacttcattcctttttatgtgtggatatagcacattttgttcatgcattcatctgttgaacatttgggttgtttctaccttttggctgttgtgaataatgctgctatgaacattcatatacaagtttttgttgatatacttgtttgtgattctattgggtatatacctaagagtggaaatattaggtcataagttaattctgttaaacttattgaggaatcaccaaacggttttcctacaatggctgcaccattttgcattcctgccaggaatgtacaagcattctaattcatgtacatccttgccaacacttgcttttctttttctttttctttttttttttttaaataagtcatccaaatgggtgtgaaatggtatctcattgtggttttgaattgcatttccctaatgactaatagcgttatacatcttttcatgtgcttgttggccatttgtatatcctctttggagcaatgtttaatcaaatcctttgtccaattgctaagtgggctggttgttttttgttgtggtgctctctcttctcttttgaaacttgtctgggagcagaagcagggattgccattttcaggaatctcttatcgttaggaagtcctcctgggaaaatgttctccgctggtcctacttctgcatgttagagccacacaaagtctgtactttctgccccatgaaagcccctcagagagttaaaggagaggccgtttgctttcataatcatctctactttaagcatttgtaagtcttttaaatcatttcttgaatgttttggtttctttgcaagggaggaaccccagaaaattaatcatgtgcttactcaggaatggaggtcatgcccaatctttacacctatgcattggttcacccctaacatgatgtttgcgaatctaatatatgccaggagctgttgtacatgctggggaagtatcagggatcaagacagacataaagcatcacccttatggggtttagatgctagtggggagacaaccaggagctgggggaaaatgtcccaaatgaagatgaacacggtgtcatgtggtggagaacacgtagattggggagtcaggaaaggcctcaacgaggtgccaggcaaactgtcttaatgccaagaattcaacaacgtgagaatacagaaaagcattccaggcagagagaccaacaggctccaagatcctgtgtggaatcatctccaatctagtactcaaatagctcatattacatttgtgtcataaagtccagtggacatttgcagtcctcatcttacttaacctctggagagcatttgaatccaatgtccccttccctttgtttccataatatagcactctccttatttcctcctttcctctccagccgcgtttctccctctcctctgctgctttcttctctagtgggccattagattttggaagttcaaggctccttcctagactccattttcttcttacttcctctctaggtaatctcaccatcactgggatttaactaccacctatatgctgatgactcccatattcctatctccagtctgaaccatgcttccaggaacaaggcccatgaatcaaactgcttctctgataacttatctgtgattttttcacaggcacctcaaacgcaatagggccaaaaccaaactcatgatcttctccctcatacctggttctgtctgggtgaacgggcacaaacacctagccacttttacaaatggagccattatatattttcttcgtcatccacttacacaactcttgactacattgttcatttcactcatcgatttctgtcaaatctatccacttctcttcatctccacccttcaaatccaagacaccagtgtctttatctaggactataccagagctctttaactgaactcttcttcaactttggccccctccctctgtttttttcatactatagagataatgctgttttttataagcaaatctgattatataatcccttcttgcttaaaatccttcagaggcttccagttgctcttatgataaaacccaaacaacttcctaccatggtcttcaaggccatgcatgacctaatgctgactcaccttgcaccgtatttaacctcactttatctgctccagccacacttctcctttttcactcacctacactttccatagtccttcccaccacagggcctttgcacatgctgttccagaaagagttatgaaacacttgtccctctcatctcctagattattcctccttatcctttagattatatctcagatggccatctccccaggaaaatcttctcggacctccccctgccttctggccaggtacctctgtcgtatgccatcagagtatcctcatttcaactttgcagcactgttcaaacttgtactgtcaaactcattctggggagtgtttagtttaatgcctatctccccagcagactatcacctccatgagggctgaggccgtgtttgcttgcctacaatgttactccaacacctactacattttggtgctgacctggtccaaaataggcactcactattgtgtgtggttttatacgaagtcctggaattttacatgtgcacataatcacacagacccaagtacagaattttacatgtacacataatcacacagacccaagtacagacacagatgtatatgtgcacacacactacctaatatatatatatatatatatatatatatatatatatatatatattttttttttttttttgaaacggagtctcgccctgttgcccaggctggagtgcaatggtgtgatctcagctcactgcaacctccgcctcctgggttcacgccattctcctgcctcagcctcccgagtagctgggattacaggtacctgccaccacacccagctaattttgtgtgtgtgtgtgtgtgtgtgtgtgtgtgtgtgtgtgtgtgtatttttagtagagacagagtttcatcatgttggccaggctggtctcgatctcctgacctcaggtgatctgcccgcctcagcctcccaaagtgctaggattacaggcatgaaccaccacacctggccccctaatacctatattttaaacatctgagtcaattaccatcaaactgaaagaaaagaaaggtaaagaagagcaccttagacaactcagcctaaagaaatgggctatactctacccttgagaagattctacctgtttttcctccatttctcttgttacttttgacctgggtcagctctctgggttgctcccctctctgttagaactgttaactctggataatgaggccaggaaagaaggccaggaaggtctgattatcctgctctccgtgcaaagcctggttcacagagcatttcagacaagtcctacccccggggcctcatcctagcaccacagacttcatttttgagtgccttaatggtagatttatgagggatattgggtttctattttccaaggggtttgaggatggccttgctgtcactgctattgcttattcttgaagacttgagatcaggaagataacagtgccccaatatcaccagcttctctctaggcctctgcgttgctcccatagagagacgtctggccagcaatttcttgtcttacagaaatctctgaaccccatctccctgtttctgccaagatattggtgggatcaccttcttttttctttcctcttctgttttgagacctccaggggcctgttctctgctcctggaacagagtaggcactcacacttttttgattccataatctcattttgctgatgagtgaatgaataaacaaatgaacaaatgtttgctgaaacctacagcatgtatcttcacctcctctatcgttattgccttataggctctggagccagatagatccagttttgagtccaggctctgctccttctcagctgtgtgaccttgccaattcgcctaatatctctgtgctccagtgtctcctctgtaaaatgagatctgttgagggattaaatgagataatactggccagatgaggagcccagacctgggcatgtagtgtaagaagtggttccttctccacagttggatactggacattcacagcagcctggtgtcactgcttggcaatgtaggatcatgattaagagcactggtttcaaacatttccttgttggattgatccttcctagttggaaagccttgatcgagtcacttaagttgcccaggatcacgtagccagaaagggactgaactgtgattgaaacccagtctctagcctttctactggaccacagggcctctgttcaccagagaagatgtaaaatatcaagaagtagccaaaacacttctgtcttgaagatgttgttttggaaaatgtgactttggggccccgcagttggctgcacgcttgtttctggttattccagagagattacggaatgctccctgggctgcccctgctgggttcccaggctctacttctctcctctccccaagccttgagtggcttgtccctggcacctatgagcctctctcttgggacctggagcccagcctagcccagctcagctttgtgcatcaggagttttgaagacaggcagcctttgtcagactctgtgggattctcccctcgctttcccagaactaagaaaggccaagcctgggactcctccatgatcaaaaaactgctctgaggatcttcaagaggctggcagaggggcaaggtattctaagttccccctcccccttaccaggcacttattaaaaatgcgtggcccagtgcctggtgtgcacacagaaaacagcaagcactaggactggcatcaagagaaaattcaggggaaaacatactttagtccaaaggcaaatcactcagaatttccaggtgatattttacatgcttaaaaatgttggcaatgattaaaatgaaaaatacaacatcaagtgtttgaggcctttgtcctcatcatagcttcatcccagcagaacacaaatctctttggtggtttggagcgtgtggccaccatatcttccaggcattcaggaatgggacctggaagaatcgcagaggggtccagtccactctgtgggcaaatcagacatctgcttcttaaagaagcatttttggagactttctggagtgtttctgatgttctagtgctgcctactatctgggtttgcagccgacccttttgattgacagcattctgctctactgtcatttacgagcacgctccccacactgcactgtgattgtgtgggtgcgtgccaggcaccatcagaattgcctgttagggttagaacaggagtcaaagagccacccacactggtcgtgcataccagcttagtttctgtccaactgggatgtccttgagcaagggcatttaacagtaaggagccagtaggcctgctggggcttggtaaagtccctgctgcactttatcgtgtgttctatctgtggagcctcctacgggaatgcagacaactggggctgtcccactgataggtcaaagttactgagggccttctgtatagcccccttccaattgagctggtggccccacgctaatgatcccggaaacgctgtccctacagtaggcctggcaggctgtggtgggatctgcactggcctctgaaggtccaggcctagtgatgctactcattcatctcagggtggagcaaggcagagactgacctggccaagggctggcagcagctcagcgtgtttggtggaccacttggcagtgcttctgccgactccccatctagcacatcctggcagagaagttgccctcccttggaggggcagtctctgcctgtcatggatcatgtaaaggtcctcttgctgaggccctgcatcttcattttgcagtttctttatcgttaaatgagggagtggtggtcaccattgtagctgtatctcttctgcctcttgagcaacacccggaggtagacatcctgagtggtagcgcctacgcctcagggagcagaggatctgggtgtcgtctttggctattccacagctaaactgcccagcagttaagagttgggggatgggagcctactccacctttatcagtgacatgaccttgggcaagccgatctgcatccctgagtgccaacttcctcctgtgtgaaaaagacaccatagtactgccccttgagtgttagcaagagaagtaaagaagaccatatactcatgaggctctgagtttggtagctgtgatatatcaagtatctaagtgggattgtacattttcacccatgaaactcttcacctgtacaaagaaaaaatttgcttcagtatgtcccatgatggctctcttcttgctcaggagtctctactctgctggaggaatcaagctgactgacaattccatggtatccttttaaaagtctcaccttggaatactatgcagccataaaaaagaatgagattgtgtcctctgcagggacatggatggagctggaggccattatcctcagcaaactaacacaggaacagaaaaccaaatatcgcgtgttctcacttataaatgggagctaaacgatgagaacacatggacacatagaggggaaccacagacactggggtgtttcagagggtggagggtgggaggagggagaggatcaggaaaaataactaatgggtactaggcttaatacctgggtgatgaaattatctgtacaacaaacccccacgacacaagtttacctatgttacaaacttgcccatgtacccctgaacttaaaataaaagttaaaaaaaagaaaataaataaaattttttaaaaaagtcatacctggatgtcattgtgccccttccctgcactgcttccccagggggcttctctgcacacctagttctgcagcccctccccagccattgctgggtgatatggtttggctctgtgtcctcatccaagtctcacgttgaattgtaatacccagtgttggaggtggggcctggtggcaggtgattggatcatgggggtggagttctcatgagtgttttgtcacctccccacaccttggtactgtatagtaagtgagttctcacaagacctggttgtttaaaagtgtatggcacctccctacctctctcttgctcctgctcgagtcatgtaagatgtgcctgcttccccttcaccttccgtcatgattgtaagtttcctgaggtctcctcagaagcaggagctgcttctgcttcctgtacggcctgcggaacgatgagcctattagacccgttttcttgataaattacccagtctcaggtatttctttgtagcagtgtgagaatggaccaatacactgggccttaacatcctcacagtcctggacatggcaccgagccaaaagcagggctcttcctaggttttcagatggaagaaaccactttcctgatgtgcacctcatccacatatagccttcaggggacttttcccttttgctactattcctttggcctgaagtggcatgggagggacggggagaaagggagtgctttccacctctttttcatcatattctgagtttctgctaccctaacatatagataagtaggcttggttcttgatgtgataatgggaaatgtaccagtcaggattctaccagagaaaagcacacacgcacacacacacagacatatatatacacacatgcacacatattacacacacatatacacacatgtgtatgtgtatgcatatatgtgtgtgtatatatgtgttaaatatatataaaaacaagaaagagcttatctggttttgggtgatgtggcttatgtgattgctagctaggcaagttcaatatttgcaggcaggcaggctggaaactcagcctcaagatcgaagcattaaataaatcctatctcatcagtcagagttccccagaagaaaagaatagaatcaactggagattagatagatagatattaatatagagatagatgggtagatagacagattttaagaaactggtttatgtgactgtggggctggcaagtctgaaatctggagggcaggcgagcaggcccaagactcaggcaggagctgacactgcagtcttgggatagaattgcctcttctctgggaaacctcagtctttgctctttaggcctctcagttgattgtgtgaggcccacccacatcatcgaggatgagtctctacttcacttcaagtccacagctatgaaatgcctccacagcaacacctagacaggtgtttgatgaaatcaccagggactagagcctggcccaggtgacacataaacctgaccattgcaggaaccagtggaatttagaagaaaaaccttttatcttttatctgtagataaagcctagctttcaagactcttttctggttgtggacacaaatcctattttaggtatcaaaagctgattctatctttgttgttatgttcttcctgtaactgttattagtcttctagttatttttggaagatttcaggggatattgcctctggaatgttgtggatagaatatcacccacaaggaaatgcaaatgagaaaaacacattaataaatttttagagggacgttttgcccaaggaaggacattttgtttttacaattacaaattattccagtgaagaagaaaaagaagaggcaactaatgaaagcattgaactcatatttgaaaacagcatgctgaaaacagcatgagggtggtggggcttgtccctgggcatggtggggacagactattggaaaggtgccaggaaggccatgtctggaaggcaaaagctgagaaacagataaggggagtggaagatgaagagcaagggccatgctgtcagccctgcttggcacttggtgaccccagaaggaatggacctgttgcttaaggaggcaggtttcatatgactgacagccagagttgggaggaactactcaattcctgttttgcttcttacccaagagatgatctcacgctgcaaagggtcccgcttgcatcaccaggtggacatggtcactgggaaacaaaatggtgaggcagagaggggttggcattggcctccagcttctcttggggagttctgcttccagggtcagacaaacctcggtgtggtcctggaaagctggagaaggaagcaaggggaaaagaggtcaatgtggtcatctatgcacagaaaagttggtttcgatgctagccaatgtggagaaggtttctaaaccaggtgctcgggtgaacctcccttgacccacatttccctcccttctcttgtgggcctctgcccctcaaaccaggggctccctctgagccaagattcccatctgataccttgttccttgcagcccagccagcgccaggccatgcccagagctggggaaccaggtgcctgggctctgcattcacatcctctcgtgggtgaacttgcacgacatgcccaacacataatggtgagtgttacaggggaggagaacagctagtgttattgagcactgttcttcaggctttacacgtactgattcctctatttaaaatgtaattcgatgggaaaggactttcattttatttttttgatgatcagcttatttaaagcaacataacattttccattttttagaaacagttttgttgagatagaagtcacataacatacaattcacccatttgaagtgtacagttgaatggtctttagtctattcacagagttgtgcaaccaccgccacaatcttagaacatttttgtcatctttaaaagaaaccccgtacactttagctatcactccctgtacctccaagccccacagccgctggtaaccacttatctcctttctgtctctatggatttgcctattctggactttcaaatgaattaaattgaaaatgtgtggactttcacgtctggcttctttcaattaacataacgttttcgaggttcatcaaagttgtagcatgtgtcagattttccttccttttaatggctgaataatattccattatatgcatagaccacattttgttcatttagccaccggtcgatggacatttgggtgggttccaccttttggctcttatgaacattctgctgtgaacattcctgcacatgtctctgcagacatttattttcatttctctgggctatatactccggaacctcctgtggtaattctatgcttaatcctttgaagaatgtaggtattcttttactcctcacgacagccctatgagataatactatttttatttccatttggcagatggagaaaccgaggcacagagaggctaagtggtttgctgacctgcccaaggtcccacagctaacaagtggttgctccataatgtgaaccccgggggctctggtgccagagctccagtgcttaacagctgccctgcgctgtcccttgactcacagactgcatccaagtcccatgaggccctggggcagctgggtctctgccgagtcttcccattgctgtctgcaggccagagtggccagtgtgccaagtctgttccctttgtccccaaaggagctttgcagccacagccactcagaaggaggcagggctctgggcaggcagcatgcagggcaggccagcgctctgcatgacactttgaaagggccacacatttcctcatttgttgctgaccgtgggccacattattgagtgtggtgctgcatttccacagaaggctttgtgccacgtgcctcacatcttcagtggccagaagatttcaatttacagaaaaccagcagatgcttcagcagtcatggcaaggctcccagatcttctaatgggaaagcctccacctgtggccctacagaggaagagaggtggagagaggagaaaaatccactttagaaggaaagaaacggacctggcctgtccttgtggaggtggcctgtgggctggagctgaagccaggcatatggggtcagggtaggtaaaagcctcctgcagtctgggatttggaaagccttgtgccgaaatcaataaccccatgaaggcccagcctgggctcctttcagatatgggccaggtcagctaactctgggacaaataaaaccttctgggtgcagggccggggcggggaagggcagagtgccccaatttcaggaacgcacgccagtaaattgggaccccacttcccccacccagggacaacctctggtaacagccttgggtaccctcttcctgatgggcagactgtgttaccacaggtggcaagaactcttataaagatatcattctgtgtgtgtgtgtgtgtgtgtgtgtgtgcttgtgtcttgccacgttatcttcacctccaatttcttcaagcaaggagcctagcctggcttcttcaggcacccttgcctcagggatgatttggagaacaagcaatagtgccactttccttcttatcactggaaaagcacattgaagcaatgcaatgagtgctggggtgggcaaggcaggaaccctgggcagggagaagcaacaaggaggagggggcttgcactttggtgggtctcaggtatgtgtacagggctcccgccactttcttttttagcaaaactgaactttaatgacacgttcctttaaacacatccatttggtgctgaaaatggaaagatgactggtatggagcagaagatttaccttattgcaattgtgtgtcacctaacgatacagtgtaaaatcactaacatcgatttccacatccctttgccccaacaatcttctgcttcatactcataatgctcggtttcatctcattattgagtttacgatctgaatatacacatgtgatgtgccaaaggatggtcaatccatgaaatggaaaaaagcacattacaatccaagaggcatccgagctctgtagataactttaaattgtagataacatggaagggagaaagacatctgaggagagaaaaagcttcaatttcagaaacctagcagctttccccatagtgatcctaagattgctagtggaaagttttggtactggcactgatgttgactcaaacctgctgccagtaagattccttggcataattctgcatcttgttgctccttgcggattcttcatcattttcagtacctgggaagttatttttgcaatgggatatggacacccatacctgtatacagtctgatctccatcttatgagcaagacaaatctttaactccaaatctcaggccccctcagagttctcttttggggagaaacagcaagtcccatttctgctgcctttttcgttggatcttttctaagtcctgctgttgaaatagctcttctagtacagggaaactgtagttagttagtagtagggctgatggtcaagttactgaagcccttaactggcattcctgaggaggaaggatgagagggtggtttcctcactctaaggttcaaagaacaattcataaaatgatgatattcaaaattaaatatcaattgattctgataatataaatgctgagtaaggattcaaagtaacaatgtttcatctaatggcctcttttgttggattttatcttcactgtcctgctctggggacagactttctgttggagggtcaagttactgaggccctctctcagcatttctgaggaggatgaatgaggaggtgtggtgttttcctgagagttttcttttgagggtaactgggaatattcaggagccaagattgggttaagcttccgtggtgaatcagtggagatccagtcacagcctgagactccttttggacctttagatgtgaacaggaaggttgatatggtttggctttgtgtccccacccaaatgtcatgttgaattgtaattcctgatattgtaggagggacctggtgggaagtgattggaatatggacgcagatttctcccttgctgttctcgagatagtgagttctcatgatatctggttgtttgaaagtgtgtggcactgggccaggcgtggtggctcatgcctataatcccagcactttgggaggccgaggcaggcagatcacatgaggtcaggggtttgaaaccagcctggccaacatggcaaaaccccgtctctactaaaaatacaaaattagccgggcatggtggcgcacaccaccataatcccagctacttgggaggctgaggcaggagaatcgcttgaacccgggaggcggaggttgcagtgagccgagatcgggggccattgcactccagcctgagcagcaagagcgagactccatctcaaaaaaaaaaaaagaaagaaagaaagaaagtgtgtagcatttccccctttgctctctctctcctactccaccatcataagacgtgctttcttccccttcaccttccaccgtgattgtaagttttctgaggcctcccagccatgcttcctgtacagcctgtggaatactgtgagtcaattaaacctcttttattcataaattacccagtctcaggtagttctttatagcaatgtgagaacagactcatacaaaggtgatgcttgaggctctcaaattggtacaggttggcctggaaagaattccagcctagtttggggagtggaaaccagacttccaacacatggtaagtcctgcatgctttttaacagctgcataatactccactgaatggcattaaccagtccctgttttggacatgggaattttctaatttttggctaggtcaaacgatgctgtaatccacaactttgtgcatgcatcttcgaatgcccatgcaagttttctctataacacatttttatcatgtcaaaagccaaatcagtttacctctatcctggagcttaaaattatactgcaattatacaggcagtagggaaaaatagattctcttcgaggttaggacccagggcaggtgtattatcaaaagctccacaggtgactctgaggcacaaccaccaaagttgtaggtgtcccaagaattaccagactgcccctacaacagttacatgtgtttgccctccaatcaacagtgaaggagagggagggcctgtgttctcatgcttcatctacattggctattatcagttgttactttggggactaatctgatagaaatgacatgacagggcatcattggtcttactggcattcttttcattatgagggaggtttaaggtcctctatgattcgttggcaatttgtatttctcctattaagtgatggttcatgtcatttgttcatttcctccttattgggtgattcatctttttcttattgttttgaaagagctctgcctccgtttcttatgtagtacatacaaatgaataaatgtttattgaggtaatttaactaagaagataaaaatggaaacaattttaaacagaacaattttgaaaatatgaaaaatacagggttaattcaggtgagcaaaacagctgaacaacgggttgagtcagtttctgtaaaatgttgtcagaataggtgaactattctgtttggttgtttcatttcatctatttatctacctatccctctatccattcacaagtagctgttgaattcttcccctggtttcatgctaagttatactggcttcagaaaagcggttgtaggaaaattaaatgccatccctctttcttctcccaaatacaaacttggtctctggctgttttcttccacctcaaattgctggatttgtacttgaaaagtacctctgtatttaaaaattatcttcccccaatattttattatgaaaatctccaaatatttagaacagtgtgaagaaaggtacagtggatccccatagaccctgctcctagagtctacaattaagatgttactctacttgctttatcacctatttctctacctatccctctatccattcatcaaccatctttgtttatttaatgaaagtaagttgcaggcatcagtacacttcatccctaagcactccagcagatcattaactagagttcaatattcatttcagatttttctattgtaggtaaaatttacttacaagcagatgctcagctcttaaggaaaccattctctgagttttggcaaacacatacatgcacctgggtagcccataaccctatcaagatatagaccctactattaccccagaaacttccctttagcccctttccggtcaaccccattgtcacccagaggatccctttgttgattttttccacatagattatttttgactgttttggcactttatataaatggaatcatatagtaaatatatacatgtatatatgtatatatacactatatatgtatatatatagtgtatatatatacatgtatatatgtatatttacatatatactgtatatatgtatatttacatatatactgtatatatgtatatatacacgtatatactgtatatatacagtatatactgtatatatatactgtatatatgtgtatatatatatacagtatatatacagtatacatatatatacatgtatatatactcagtatatatacatgtatatatacacagtatatatacatgtatatatacacagtatatatacatgtatatatacacagtatatatacactgtatatatgtatatatatactgtgtatatatatacagtatatatacagtatatatatacatgtatatgtatatatatactgtatatatgtgtatatatacgtatatatactgtatatatatatagacacttttgtgtctggcttcttgctctcatcataaagcacttgaaatccatccatgttgtagctggtatcagtagctagtttcttttcattgctgagaagtatcactttttattgatgagtagttttacattgtatgaacatgcccgagtttgtttatgcattctactaatagacacctgggctgtttgcagtttttggctattacaaagaaaatttctatatttttttccaacttttattttaggttcagcgggtacatgggcaggtttgttacatcggtaaattgcatgtcactggggtttggtgtacagattatttcaccacccaggtaataagcatagtacctgataggcaggtttttgatcctcaccctcctccctcaagtaggccccagtgtctattgttctattccttttttttttttttgagatggagtctcactctgttgcccaggctggagtgcagtggtgcgatctcggctcactgcaaggtccacctccagggttcaagcgattctactgccgcagcctcccgagtagctgggattacaggcacccaccaccacgcccggctaatttttgtatttttagtagagactgggtttcaccatgttggccaggatggtctcgaactcctcacctcaggtgatccgcccgcttcggcctcgcaaagtactgggattacaggcgtgagccacggtgcctggcctatggttccattctttgtgtacacgtgtactcagtgtttagcttccacttgtaagtgaaaacatgcagtatttggttttctgaaattcttgtcttcatctttttgtagacaatccactacttttatttttaaatattaggaacaatagcctctgtgtgtcctgaattgcaatgttttttctctgattttgctgctcatcttgtaacctgtatggtgtttttctgtgtgcaagctttttactttacgtgggcaattttatcattcttttcttttatggtttctgggtttcatgtcatgattggagaagcttgatctaccctgatactataaaaatatccaccttggcttttttttttttttttagatggattttcactcttgttgcccaggctggagtgcaatggcgtgatctcggctcaccacaacctctgcctcccaggttcaagtgattctcctgcctcggcctcctgagtagctgggattacaggcatgcgccaccacgctcagctaattttgtatttttagtagagacaggatttcaccatgttggtcaggctggtcttgaactccccacctcaggtgatctgtctgcctcggcctcccaaagtgctgggattacaggcgtgacccaccacacctggcccacgttgttttctgatagtgttttcacgtgttattttttctgtcttactctttgaatcatctaaatgtatcttaatgtcaggagtgaggtagaggacccagttgtttggtttaaatgactagccagttttcccaacaccaggtgttgaacatccctcactgatgtgagatgctgcctttttcacagtctcaatccccatgtgcatttctatttattttccttccactttattcacatctttttcagtatccacaaccatattgttttaaatagcttcatgatatgttttaatatttggtagagctagaaccctttcttggttctttttcttttcttcttctcctccttttcctcctccttctttctcctcctccttcttctttctttttagaaatttcctggctattcttgttttgtagtcttccagataaataattttgaatcactttgtcatgttccagaaaataatactgccagaatttttattgtgatcacagaagttttacagattcatctgggggaaaaaaacccatcttcccagaatacagaaagggtgagggaaagacaaacatcaaggacaagtctcaggttctggacttggagaccaagaggatttggggcatccgggagcagggcagggaggtgtgatggctgcctttcactgagtaggaggatgcccagacttgggggaactatggaaagtttggttcagactttctgagttggagatgtctatgcgcagtccacagggcgaagccctggaggtagaggccctccttactgcctccctcattcagtctgaggtccattctccacatggacactgaagtgactcaaggcttcccttgttggatcaggatagtctccagggccctgggtggtctgggcctgcccacctccccatcccctctcctgcctgccctcctcttgctcactggaccccacccaccagcctccttctattcctcctgacatttgcacttgctgttccgtctctgcttggaacatcctagctctttgcatggcttgctccttcccatcttttaatctaagctcaaatatcactccttcagatatgcctttcccaaatatcctagctaaagagaactgctccccacttcccacaagccctagcaaactgggactctccttcttgctttctttctctctgccccttctgtgttttttccatagaccttaacttgttactgttttatttgttgatgtgtttacatcatttgtccccctgtgatggttagttttatgtgtcaacttggctaggctgtaggggctgttcgtcaatcaaacactgatctatgtgtagctgtgaagggattttgtagctgtgattaatagttgactttaagtaaggaagattatcctggagaatgtgggggaaggggcagacctcagccaatcagttgaaaggccttaagaacaaagctgagatttccccgaggaagaagaaattctgcctgtggactgcagcatcagctcctgcttgagaggttccaggctgcccttcctgacagcctgtcctatgattttggacttgccttgccaggtttttcctctttcttgaccccccaaaaccatatatatctcctgctggtttgtttctctggtgtaatcctgagggatgaacactcctccctcccagttcactctgggagaggttggggatcatgtttgtctatttccccatgcctggcccatgcgtgtttattgaatcactgaacaaccacgcattaggaagccagtcatatgtgcttcttcagaacctcatgtccattgccagatctccctggcttttgtggctagaggacaagtgagagatagtagcttacccacagaccttggccctgaggcccccaggggcctgagcctgctgtaagggaggagggagcccctgaggtctcacacacctccctggggatctggcattttcccctggggctggcctcagagctgggcgggggcagattatggagtgggttgtagagggagcacctccccactagcaatcatggttttttctgcgcctctcatagggaggcctacaggcctccaccttcagctcttcaggagccacaggcagctgagtgacttctgcatcacagtcttctcagagacaaacttgcagtaagaaagaggggcccgtgagggaccccagagaaggctgttgtcaaagcaggatgagagtgaactcttccatgggggacacccagcgtctccaagctcttttatgctgtcttcaaggggtctagagagcttcagcccaacatgagacccagtccagcagcatttccctgcgaagtgaaagttaggaccctgactagatacaccacgctgacctcagccagaatatcaagatgctgaggcgctgagatgctgggatgctaaggtgctaaggtgctggggtgctggggtgctaggatgctgaggttttgtgatactgggtcgctgagatgctgggatactggggtgctgaagtgctggggtactggggtgttgccatgctgaaatgctggggtgttgggatgctgaggtgctgggttgctgggatgctgggatagtccttggatgctgcggtgctgagatgctggtctgctggtctgctggggtgttgggatgctgggattttgggatgctggagtgctgcagtgctgcagtgctgaatgctggagtgctggggtgctggaatactgtagtactggtgtgctggagcattgagatgctagggcactgggatgctaaggtgctgagatgctgcagtgctggggtgttgggatgccgaggtgttgggatgcttaagtgctggggtgttgggatgctggggtgctggaacactatggtgctggggtgctggagtgttgagatactgtagtggtgggatgcttaagtgctggggtgctgggtgttgggatgcctaggtgctggggtgccgagatgctggagtactagtgtgctgggatgctgaagtgctggggtcctgagatgctgcagtgctagggtgctgagattctgggctgctggagtgttggggtgctgggatgctggagtgctgagatgcttggacaatggggtgctggaatactatggtgctggggtgctggggtattgagatgctagggtactgggatgctgaagtgctgagatcctggagtgctgggctgctgggccacaggctcttgaatccattcgtctgcccaggggaagaaaccagaagataaagagctaatgaaggagctttggttgagagggaggaagtaatggaaggagcaacatcttgtggaggagcaggagagaatggacctcaggttgggagagagggccaggctacaggccagagaggcagaaggattccagcagagtgtgggctccaggagccaaggggaaacaggtttctgggaggagagagtccagtactgctgaagtggcaagtccgctgaggaccaggaagcttcatttggctttatgaccaggaggaatttggaactgtgactagagtacttagggggaaggaggcaagactggagccagattgctctgggttgaggggtgagtgggaggtgaagcagggcactgtcactcctttgaagggtggcagagagctggaattggtgctggatgggctgtggggtgacagggtcatgtggaaagcccctggggggcacctggaaaaggagaagctgacagtacagtgagaggacagctaagggaaagcggaatggcagaacacgcactgccaggaggaatgaggatagggtcaggagtgccaggggcagtgaggccagcctggggtcaggtggcaggacgtgtccaggaagctggtctgcactgcagcccacactggctcagccttgaggttccctgtgtggttggggtaggaagttgaaccctctgggaatggaagatggaaccagctctgcgagccaagctcagcttttatctatgggtctctgagggctggcagagctgagtggggacaactgtgatccgtgaggctctcaggttgaggtggcccctccgggagggcttcattttcccagcgggtaggttctaagcagcagtggctgggcaggtgggtccaacacagagccagagaagggtgaatgggcctcctggcaccccacccctgctgcccctgagctcagtgatggagggggacagcacagctgagcccaagtgctttggtgtggccctgagggaaagctgcagcctgcctggggcctggcatggatgggacacttgaggcagagggacaatagtgggcgctgcagtgaggctggctcttggagaggtttcctgaggagtgctgcctgagacgggcagggagaacagagacaaagttggtgacagggaatgaaagctgactgaaggactttacccagacctatgaggatatctctctcagcaggaagcaggaggggactgtgtgaggactggccaagagctggagtgttgggaaaatgactctttctccgacccctctgtcctagctctggcccctggactgcggaggtctgcttccacccccattggtcgatcgttgtcccttgtcacagccattgagaattttggcagggagcatgttcttagagcatttttaggctctgcgggacataacagctctgcctcagagcacatgcctttctcagctcctgaaagccactgatcaaattggaacattttgtaccttagggatgaggatatcaactctcccagccacttagagggataaatgtgatgatgcattcaattgtgactacatctgatcccaactgttgcttcagctgctctcctatagcacatggcgggaggcgtgcatcccagtagctacctccccacttttggggagatgtggttccatccatgaaacctgggtacccgcctaccaggtcctggcctatcaggtggcagggtctggtcaaagaagggcatgtgtggtcttcagcaagggagacaggacggtggtgcagagcgtctagaccctcagggcaagtctcccccacacctgctcccggggcagttgtctttgtgacctcccatccccctctgtttcatcctctataaaatgaggggctgagccccaaaataacaggcttctttgccatgatgcaaaactgctgaatctttctttctgacacacaaggcatcgagcagcctctgaaagaaccaaagccactagcaggcttcctgacttgggtttgtaggtactgaatactcccttgaaaaataaaaacatagaggcacttttctcctggctgtttattacagaacgaagaaaaaacacactggcttgaaacagacgccagatttcaaatgtagaggtgaaatacgaggtggcaattaaaatgtgattacagaaagtctggacactgagaaaagtttacaggacagtgggtgtgggttttctataacagacacttaaatatacatgacgataattgcagatagaaaccatcaaagacaaaccccaaatcaactaataatgtttacagatgttcccccccaaaccacagagccttacatcaaaacaaatactgaaaggctttaaaccaggaacagctcgccttaaccccacgagggtgcacacaagctgggctttttctctcggtctgaatggtaaagggaggaggatactctagctcctccaggtggattgctgagacagggctcggctcacacactgtctctgcgcctctcccaaatctggagaactctcccagcctcctggtaaagtgtctctgtggggcacttaacgataaaacagcttctgctgtaaagctcattaggaaagagctagcggagactgaaaggttcgcaaaagagattaagaatcacacaaggcaataggatttttagtgaacatagaaataaatggccaagtggttttctatttggcatttgtcaacttgcacaacaactcttggtcatatccacattgctcattgcattaaaaccataagcgactcagccacctagcttaacaaggtatcactggagcaaacaacacggtctgcatatttgtaacattgtataataaacacaaaacaatgcatagtaaacacaactctactgaaacaaaagccgtcgctttatttacaaagtcacaaaatgaagtataaatacttctgtcattaatgtttaggaaaaccatttacaaaattttcaaatatgtacacgtagcttgaaaaatcaccagctttccattttgtcacaggtagagagagggataagcatgggctgacaacaccactcaaattgtaacgggagacaactgcgggtatggatcgacaccacttcctagagtgatgtcaccatgggggtttctatgggcatcctgctcagatttaaagtgccccagcatcctgggtgacttgcccagaattctgggctgtggcattttgagcagcagcatgctgttccaaaatgtcgtcgatcagcctcaagttgcacacccagtcttcatctgggctcacacaggagcctttcaagagagcttcaatgaaatctacctcattgcagtcaggtgacgaaatcagatcatttagtgggggttggggctggcgcaaaaagtcggcaggtggcagctcagggggaatatccgttctgtcgaacggacctgggaactggctggcagcaacggcagaagcagcagcagcggtggcagcagcagccacatagcttggtggctcgatgccctgtatggggctcaggggactaaagctggccataccctgctggaggaacttggtggtgtttgctacaggcaccgggccctgtaccgggctctgcctgaggctctggctgcccagcaggctgaagctggggttgttggccaggggcacttgtgttcccatcgcagcgggcacttgtgcctcccaatcagatggcctctgaaggcaggcctggccagaaggtgagtgctgctgaacgctattatccacttggctgaggggtgttttccccgaaactgctgtggtcacagctgctgccgctgtgacccatgcagcattgttgaacgcagtgggcattcttggcacactaggccgtctgagctggtggggactcaaggactgggtgcccagggagctgggacagaacccaggcaggggcacttctggtggggtggccttggggctctgcatatgctggcagacagagtcaagtctgcccaggggagtctggcctgagtgtgagaggatgggacactgggggctggaggtgaaaattccttgccgcttccccagagttggtgagatcactcccatgccctcgcagctctggtgcctggtgagtgggatcattcctggactcagattgttctgaagaagcccagttctgggtggcatcaagtgcttgctagatggggggcttgccttgatccggctacacttggaggtgacttgttcttggacggctacatacagaaagagagaagtggggatgagttccaaaggcatcctcgacttcggctgtggccaccggagggtagctcctggcccaacacggacttctcacctcccgcccttggctctctactgagctcccccctgctccccaattcctcgccattcccctcatttctctgccctcagcctggactgcagttcttctgggaagctgccccaactccctaggtctgtgctcaccaagagcagatcacactggactgaaatgccagctgatttgtctcttcaagaaaattggaagctcctggaggtcagggtccatgtctgcttttacactcagtgctctgtatgcaggcctggcactgcccaccctttgacaggtggtgcatattttgtagaaggaaggaaggggccaggtggggtgggctgggctggtggcgggagctagctcagcctcttagattctctacccgatggatgtgacctgggacagcaagtgagtgtggtgagtgagtgcagacggtgctttgttcccctcttgtctcatagcctagatggcctctgagcccagatctggggctcagacaacatttgttcaactgaacggtaatgggtttcctttctgaaggctgaaatctgggagctgacattctggactccctgagttctgaagagcctggggatggagagacacggagcagaagatggaaggtagagtcccaggtgcctaagatggggaatacatctcccctcattgtcatgagagtccactctagctgatatctactgtggccaatatctaccggtacttttttggggtggacactgagtcatgcagcagtcttatggtttacccaaggtcaggtaggggagacagtgcagtcagagcacaagcccagtgtgtctgacccacccaagaatccatgctcgtatctacaaaaatgattttttctcttgtaatggtgcctaggttcttttattatcatggcatgtgtatgtttttcaactaggttacaatctggccttataaggttaacctcctggaggccaccagccttcctgaaacttgtctgtgctgtccctgcaactggagtgtgcctgatgtggcactccagcctggacaagtgggacacagactccgctgttatcaggcccaaagatgtcttccataagaccagaagagcaatggtgtagaggtgtcatgggctacaataaagatgctgacctcctgtctgagggcaagcagcctcttctggccctcagacaaatgctgagtgttcccaagactaccctcggcctggtccaatctcatcccactggtgcgtaagggttgctgaactcatgacttcttggctagcctgcaacctccacggagtgggaactacatcaggcattttgctaactgctgtatcctaggccaataaatgttgatcacatttatagctgccatggtagggtggggacccctgctatctatctgtggaggctctgggagcccctgacacaaactttctgaagcagagcctccccaaccccttttccattccctatacctgacagatggcccaggaacccattagaaatggaaggtcactgcagcagtatgtgaatgtgcgtgtgggagaagggcaggatcagagccctgggggtgtggcagcccccaagtgattctaatccagatcctagggttgtttccctgtcccattgaaatagctgctttaaggggcctgactcagggaaatcagtctcttgaattaagtggtgattttggagtcatttagaccaggccttcaattgggatcctgctcttagagttggatgaattatttaactgattttcagatctcctctttctcaatgctttcagaagcacagtaactgcttactctgaaatgaattctcaccccacttccacatatgcaccccttgcccacccctttgggaacactggccttaactgcttaccttcaaatggactcatctgttgggagatatatgcattctgccgttcaggggtcattgccataagacctgatctctgttcctcttgctaaacagaagatgaaaaagacaaattagattacagctaccaattaataattagccttaggatcgctgcgtggggacctaggacttggctttggtgcagcagaaagcatgaataaacacaccagcatacactcgcatgcatgccccaccctctcgagcaaaattccacaggtataaataaagtaagattctgcacctgggttaaaaacacaactgcaacagcatagaatggggcaggagagacagaacttaatagcaagagcacacagaaaaaagttttaggcattttggatgtccatctgctcaggatgggtcagcagtgagatgcggtcaccaaaagaacaaatgtaacattaggctgcattaatagaagcagagtatgtagaaggagggaggtgacagtcctatgctaactctgccttggccagactatacccacaggagtctgggcatgccagtctcagggagacccagacagactggctgcattcagaggatggtaagtaatgagagtggggattggacttcaaactacccagacaaagaatggctgagcaagccaaggatgctgtggctggggcagagcagactgtgggctatgtagtggtggatacctagcctctgcagggctgtcatagggaaaggacattgagaagaggactgaggcttgttcctggtggtcctggcatgaacggccagatgatcacatggtcaggtggacacagtctccaacactgggagtagccaaacacttactgccaacctcccgcccttctcctgactagttgcagcataggcaattgggaggagcttcctgtctccatctgaaagctggctgggtgggcagggggaggagcgagccaagtttcaaggccgcagtttcagcactcagtctgggatcggctcaaggagcaaaggggaagaacatagccaggagggaataacatgaaggcccccagacccagaaaaggcatgacttgctctgagaccctcagccggttggtgtcaggttgtgactcggatccaggtctgactcccagtccagtgcttgaagcctcaccccacacagtgaggggagcccggccatctctgctcaactgctgccatctctctccccttctcaaccaccaaggcagctctgtctgggagcacaagctccaagtccactttctggtctgtgtcccccccaagatgccagaggacttgcctctacaacacgggctgcccgtgcagtgcctgcttttccagcaaagggcttctgggaacccttctctgcactcagtggggctggtgggagtggggcggggtagcgacccagtgcttgggactgtgcccagctctcaggcctggcagcagttcctggccttggttcctgccaaggcagagaggacaaacacatggcaccgggaagactacaccagaagcgattccaccagactggggtttgcttttctatcccgcccttagcctgcttcctgtcctggtccctgcctccccctccactggagctgccgtgtgggcagtgaggggctgtttctcagctgccctatggagctgccctctccctgccaaagcattggcaaggcggcaaggggtgggggtggggatggggggtgggatctgccttctcaagctctcattatactgagcacgtctcacccattattttatgtcatctagcaacaccccatgtggacactgaggagcatgggggtcacatgaccactgcccaaggccacaccatccggatctgcctgagatggtcagggttggcagccatttctgaaggcagtcctttcgctttggctcttcttgtaccagtctcaggacatcagggcagaagatctacagtccccagcttactgatgtgacagcagaggctcagagaggttaaatgacttgcccaaggtgacacggctaagaagtacagtatctcctaactgcagaccaggtgcttctgctgcttctggggacagattcctgcgtggctggctaggtctaaacggtccttaactccatccccaccggttgctgcattagtttcatcaaataacacagttgtacagaggtaggggttcaggggcaggggcagatggaggctggagagtgtgactaaggaaacagcaggggaagtgcggtaaagtccgaagggagggacggaaagagaaagccaagcccaggggcgtgccagacaaaaggaaaggccacgccggggcagggcaggcttcagcgggtgctggggcgtcttcatcccgggaagcacacattccagaggaccccggagtctaatggaaaagctggccagcctatcactatggaaactgccaaggccacacagcgctgctgacacccagcctgggtgccggtggccagctctgcaggatcttcaagtctggggtgccaccagcaagcgacggtcctccatgggctcttcaccttacggcagtgtccagaggcaccgccagtcctctgctcctatgctggtcctgctgtccctggccaaaggagccagagcattctctccaggcctcccgaggaggctgcttcctttgttttgcagatggaggctcccatcctttgttctgaatcaatgtgctccaaagataagccccaagaaaacagttgttgccttttgacactgacaattagaatcgttggaaaatggagaaaacaggaaatggcaaatggtttcagtgaccaggaggaaaccgtgcctgaaagttgctgcttagtgactgggacactcgctttctgctctcttatgaaggacagcctaggccgtgtggccttttataaacaaagctatgaaggggtcgtcaaattttctagggctgcaactgtggcactacgtcctgttgtgccaggtgacactgacaagcagcactgagttctatgcaagcccaggtgtgcttctctcatggtgacccccagagaactaaggcccagctcttcctctgtcacacccctcccagcccccactgtcagacaagggaccacattcacagacagtctcagccaagatggcaaccttggaagtcctggggatgcctttctagaagctttaggctgacgccagggagctgtaaagcccccacctgtccctgggggttgtgtgctgggcaggagagaggggaaagagcccaaactccaccactgcctgctggcacaactgagcccacgccaggcactgcaccagcttcactcaccagctaccacatgctaatgtctcctgtttacccaggtgcaatcacctgagtgctgctttctcaccactgcatgggaagaatgatctcattaccaattcaaccacttaagcaggcaaaaggactccaacgggggaaaggcagaggacaaacgattcggggactgagacagatgcccacaaaatgttcctggattttagccggattcgggctgaagttccttgccctatgagcccttggaggagagcatcctgactcagacaagaattcaaatgacaagacttctgggggatggcagtgaatggatccaaagccttgttttataaagaatgtggaggaagggaggaaggaagggagggaaggggagactgagagggagagagaataaagaagaggaagagaaggaagaggaggaggaggaaggggaggggagaggaaaaaggggagggtagaggaggagggagaaggggaagggaggacagaagaggggagggagcggggagattatctacccctccatgctagggaactcctgtctccttttccagcagacactgctccatgagtgcccccacagagagccagcctgccacacagcagaaggtgctcagctatctgtcccaaaggttgagcactagtgtattccacaaggaaaaaaaccttcttttgtactgtttggaagccagaattagaaacaactcgttcacccttctgactttccctttgcaatgacaggaagatagtatactgcatgggaccaccacacattcaagatctgagttgtggggacccccacccccacatgggtggagccccctgagacccgtgggctctgactggccatggcccatagatagtgacaacatacacactgctatctgaagcctagttggaggacggatggatgcttttaggaaaaaattccctttagtcgtccctcagaaactacaacggcttcctaaaatgaatggcaggcaagttttgattgtttcctaagttccccctaactctcagagcctgtgactcagcttctccagaatgcctgcagggaggcaggaccactgggagtaatgagcacgaattgggccacttctcccagtggactgttaacgccgagatctggggtggaacccactgaacacctgcccttttgcgttgcccagaatgcagccagagggatacgggccacagtaactctggggcccctgaacctaccttcccaagaccctgacgggaaggtattgcttacatgacagtccagtcagtccctctgtcactcagttaacaaacatggtcatgggtctactatgggccaggctctgttccgggcatggggataacaccgtgtgtctctactcttatggacacaagtaaatcaatcaaagcagataatgttctaatgaccacccagtagggtgaagggatggagggtgggcaggtgctggcagaaacctaaggtcaagtcatgggaccccaatggggaactggaaactgccacaccattttctatgttaggggtctttccttgcccttctagagacctcacccatggtaatgatgctgccctcaggtttgaactggtctgaagctgtcactgggggcttcacaaaatgaatgccactgaaagcaaacggcagagatctgtatatgaaattctttttaccctttgttttctgtcttcccacatgatctatgactgctgcaaactctattctgactcctcctcagtcttggccggtctgggaagaacttggtttagatgctgggaatgatcccgggcaaaggaaacaaatatatttccagcttgcttttcttcttcccctgtggtgcctgcatcctctgtctcgcactgactcacaggctggactgacaaagtggctgtgttgacagggaggatttagtggatgccaggcctgaccctcaaaggccctcaggtggggccaatttccaaggttcttagagaagatttggggccacaaatctgctctgccacttcactgctgggtgaaagctgttggcttgagaagagagagaataggtgagggacaataattctcaaggcaagctagctgatatcctttcatttgtggcttccaaagacagggaaaggcaaggcagaccagggtggaaacagcgacatcctgaggggacgacgtccgttttgctaattctgtttccctggcagctttgtgctggacaagatttctctggtttcagctgaagagtgaacagctgaggagctctgtgactctgagagagagagaaatcaatagcccttgaaaggaaagcactgcttgttcttccaggccagggcaggcaggataaagagaacaaggctgtacataccaaagccgaatttccattaaaggccagaatcctgggaggccctttcagcttaatgaccatcttctgatcactatcacttagaaaatgttcatgtctccagttttctctgcagatagtgcagacatcctgtgcacattgatattttatgcaccagatgcaattctctgcaaaggtcccctctggctggtgtccatccgcttgctctcatgaccactgatgcgactctgggggcaagtcaagccattccttctagactctagaatctagaggatgatcccaactcacaggcctcttggacaagcttgctttggattccttctgcctgtactacccagactgccagtcctccagcagggcaatccaacttcctgcctctagggtgtgggagtcctgggcggggtttggaatccacagcagatggctggcaggagaggcagttcccgagcacccactaggtgccaagcaggcaggtatcaggtgcagggcttcggaggtgcagaagcacagcccctgtccccctcaggttcccagtctggcctcagggacagacaggcaggtaggtatggaaacggggtactggaaggcatacagctgagggagagagcagctgcaccctggtcaatcccccactcatttccctggaggtggggctgaggcacctggagcactctgcttgcttgggttgtccctttgccaaagaatgccgggcagaaagtagagaacaagcaggcccaggaagcactagaagtccctcatgggtggacagagctttaccttcggagctgtcacctcctgtgttcctcccaacaaccctgtgaggcaggcgggcaggctgagcaggggactgtgccccgttgacagatgaggaaagcgaggctcagggggaagtgacttacctgtggcgtcgcagctaggcagtagtggagcgggcacctgcctccaggccttcggatcccagctgccccagggcgctgcctctgaggtgctgtacgaggaggtgactcgggccagctcatgagcaaaggagctgccgggcaggaaggactcactccccagggcctggcaggacgggggctgtcgcccgaggctgacctgggggtgcctggcttccccaagcttgcaggctttgtctacatgagtctacaacaaccgattgaacaatccatcagctgcttggccacaaaatggttctgactgatcttgtcactgccctgagtgtctagctgggtcatctgggtgttgtggttatacccaccaactgctttggtggaacgaaaccaaacagctttgtgatcttagcttgtcttgggtcatagacttctttgagaaccagttataagctatggtttctctccacagaaaaagcacttatggtgtctccccctttccagcccaccaacattttacatctaatttgggggggttttctggaccacttaatacccatccatggatctcatgtgaagactcccctggcttgagaaatcactgtcttgttgaaaatgggaacaaagctaagtcagatagctggttcatcagcaatgactttgaccaagcctgatcccaccctaccccaccccaccccagtgaccaccccccacaatggagcacacaactctaaactggtttgtaggtatgtgtgtgtgaacacgctgaggaatctgcaaaaccaaatggtgagtgcaaaaccaaacagtcacgagtaaatctcacaacaaccacgtcctgagctgcagcccttgttgaactataccccactagggccccaagattttaggacttgtgtgtgggtgggacctcccctttctatcatgctttagaagacagggatttcaccagaattgaacatattgaacatatgacccatttttttcagccaaaggcaattaaaataacttcatacttgatatccatgtcagcaaaagctgcaaaacgcaaatgggtggctgctaagagccctggtaccctgacgagcacaccaagtgcttagcaacagtggtgtccaaaggaccagctggaagcctgccttgatgagaagttgctcttctttctacatgaaggaacacctctactctcctgcttttaatacctgagctgtgagtgatcatctatgtccattagcaaacatcccagtggagaaggaaacactcatacccgaaatctaagctacatagttggaatcacttcaacttattgcaataaacacttactaagcacctattgtgggcaagtctttgcaatggataatagttcagtagatattttgatgtaatatttgaaataacaataaaaattgccaccactgaatttattgagcatttgctgtgctttaggcactaacccaggttctttaaatatttggtcttattcgatctgtataaatagccatctatgagaaagggactattattgcccttattttacaaatgaggccaatgaggcccagagaggttaactaagttgcccaaaatcatacagcccactagtggcagagcaggatgcaaacccaggcttgcctcgttcccaagcccacatgtcgtttgcattggtgtggaggtgtgcatgtgtttagtcattagcatgttatatgataagcaagttttgaaacatagaaacttaaaatgtgccattaagaaaagtacaggcaaggttttccaaggggaggtgtggacctccggacaaatttttaagaactaattataaatacttaaaaatgggaataagaagacaacctaactacctgaacagttttagagatgactcatgcccaccctctaaaacccaaacaaaaacaacaaagtcaagaaaacccatgaaatcttagcaagcgatttctatgtacttgtgaaaaggatttctttaccattctaatgggatttatgccaaccatagagggctcagtgcccctcccatggggtggttagtgagtacagagctgagctcaccggccatctgcagcttcatgttatcaagctccagtttgtccttggagcaaggttatctgggacatgagcagaggcattgctttctgcaatggacagttctttctgcctgcatacctagctccttgataactttaaataccattttatagccacactggagttttgaagacctcaatatgcaaatattactcaggttctgattacttgtctgctccatgataacacactctaaaagcaatgaatggggcttatttgtagagaactgaagcattttaagcttttgctcaggaatccctggtagcttcctgtgacttgcaagatattagtgatgggtcaagaaacaggaccccccatcagcataacatacgcagtgcctcagtagtccatcaggcagaaaaaactgcagatggcacatggaaatgaccagcggcggaagataccccgacagtgtgggcagttctatttcagcagcaatcaagagggggcctggagccactcaatcaagtggagcaggatgggagcaagcactgtgcagaccaatgcaatccccagttaacacaaaaaataaataaaagagatgagattcagtctcttgactgtgactgactgggagctttatagctgatgcttgtgtcttttctccattttatttaattaggaaaagaaatgcttatcacacactctacgtgtgaggtacaacctccacaggaaaggttgttaggaacatttcaacttctagaagtttctaaacataaggtaaatccatctttgtccttgggatcactgcacatctcagaaaggcaaataaatcagtaattggtgggcataattactagctcatggactgacaaggtctacactatttcgaatctcacagaagtaagccatgggacagatagagtctgatagtggtgccccgtttcctggaggtcacacttactcatccccctggaccctgggcttctcatgattgtcagagagtttgctggaaccaggtcagcccagtttcccttcccctgaaaaatcctccaatggctcgcaccaagactagagatgcaagtgcaagcacatccaccctctcagcagccaggttttgcgttccataatgtcacgtacccccagtcataccaatctccttggagctctccagacaggctgccatgtgtggtcggccctctgtgcttgtgctccttggtttgccaagcctggaatgccctttctccatgattgtactctgggaattctgtgtgtctttcgagatgaagctcctccaccctggaaattctgcctctctttccaggtccagctcctgtggctgaatacccttggctgactgaacattcttgctgggccaagtcttaatcatctctaaatccctctggtgccccgacagtatctagcccaggcaaagggctcagcaaatacttgcaaaattcaataaactttactatgttactagcttggcatgatgttctaggcacttgggagattataatctggtgagcattgtgctagtcttttttttgggataaacaccaatgataaactgagcctttactctcattttagcacatctactcatctcttttcaatgctggtgggtttataaaacccatcagtagaacagagagtgatcataatcatatggtgaaaataacatcagctaacatatttactgaacatgctttagtgtgctgggcactgaactctgtgcacatgtgaatttgagatagattgttcctagctaataagatgaggaagtggagatgggcttactcaagtcacacaatagcaagatggggtacagacagaaaccaagctagaaaccaagcaacccctgggtttggaaatgcatgggctcctcctctgcacatggcgaggagcagtcaggtgctcctccttctctcatactgaaataactctgcacttttggctattctgtgacactctgtgctattctgtagctcaaatggctctggtgcaaggagctcagattatgactaacccccatagatattcagctgctttgcaagaagtggatgaatgctctggctttataaattattgactagattggatattggcccaatctccactctggtgattcggaaggaggcatatgcacatttgcaaggttatagtagtgcactctaattccactggcttctgagagcttgtaggtttcttgacttaatcattctggaattaaggtaatggatcctcaacaccttttctttccctggcctttactaaccatgtaacagaaatgagcagagaaaacccaagaaagcgaactggagacttgatgagtgtgtcaaagatgctcagagtccaaggtcctctgtggctcactgacttcagaagccaacctccgttgttcaagtcacttgtgaggttactatgctagagcactaaatattatccagatagcccaaagaggtgaaggcagacatgtggaagaacctggatttttgggcaagttgatgaatgcctcctgccccatatcaaagagaggtgataggagacaactttgtgaatttgaaataatgcaccggggaaacaggaaaacgtaatgtaagtcacgcttcttggcttttttcttgccattaccctacttggccaagtgcaaatgggatttcaatatatcataagtatgcatctattaataacaatgcaagaaagctgtacaactgaagtctgagattttgtaagaaacagaatctctgtaagcatcaccatccaacagaacttcctgagttgatgctgaatcatcccagaaagaatagaatgctctagagctgtgctgttcaatatggtagccactggccacatgaagtgtgtagcacttgaaatgtggctagtaaaaatgaagaactgaattcttgttttttaaattttttattaatttaaatagttacatgtgactgctggctacagcagtggacagcacagctctttggcatggtggctaagagtccaggctctggaaaaagagagtctagacttgaattatgggtttgccacttccatgctttgtaattgtgggagagttacttaacgtttctgtgccttaattttctcatctgcaaaagggattaataattgtatattattcatagagtggtaaaggttaagaggactaatagaattagcacgtatgcagtgcctggcatgttgtatgcactccaggaaggttagcagcagcattaattaacaataatacctccaccatatatcgagcccctttcaatggtccaggcactgaattttacacagattagcctaaaactggacatgctgttctaggtgtggtctggccaacatggctcagcaggacctgtgttttggtaaagtaaattaataataataataattgatgatgatgatgatattataaatatttactgagaacttactcagtgtaaggcactgaccctttcctagggtcatttcaattaatgaatcctcaggacaatcctatgaaggaggtactattataatcccattgtaaagataaggaaactgaggcacaaaaaggttaagcgacctgcccatgatcacccattagttaagtgccagagcctagactagaacctaggtattgtctgatttcaaagcctgtgccaagctttgtgtgatcaaagtgcccaagtgaaacttttgttattgcagtaagtagactaacagcaagaatattttgtaaggccactgaggttctactgtgcaatggccgcagagctggctgctgtgagacccaggtgtcctcttctttttataataactgtaccttgaaatgaggagaactccaagttgggggacctctgttatgatacgtgtggtatggtgggtggaggggggtagataagtctcactaaagaaattctggctgggcgcagtggctcatacctgtaatcccagcattttgggaggctgaggtgggtggatcacctgaagacaggagttcgagaccagcctggctgacatggtgaaaccccgtctctactaaaaatacaaaaagttagccgggcatggtggtgcgtgcctgtagtcccagctacttgggaggctgaggcacgagaatcacttgaacccaggaggtggagtttgcaatgagccaagatcacgccactgcactccagcctgggcgacaaagtgagactccatctcaaaaaaaaaaaaaaaaaagaaaaaaaagaaaaaaattttttaaaaaagaaattctacagaaaactctagggtagcaccaatcccacccatttggtggatctgttctgtaaatttgcattttgtaaaagttttcttggagcagggtatcccctaagcaagacctggaaaaatttaggctttcctggagtttttcctccacaaacgtatataatttaactttaacatttcaaaatatgtttagggctgactgaaattgactgggtccaaaatcaaattcacttcatcatgtaaattctcagatttgaaatttaattagagaattaagttcaactgataaattgctactttgacaaggggaaaaataacccaataacaaaatggtagaatccataatgtataaagaaatgaaggaattactatcccctgggcagttacctcactgtggcacattcctgtggatatcccatagtgcttggcatagagtgaatctgcagtatacttcccacttctgaggttgaggctgtggggcattttcacagtgaccaaggctgtgcctgttgtcagcaatgctggataatgaggttggtgggccactgggcatcatgctacttgggggagcatcagggacggggtaaaagaggaagggcatcaaggctctccagagtctagagttttagtagccaacaacggcctgtggcaatcgttgccctgacagtttctggaaggtttctattttctcatgatgatgacgataatgatgatgacaatagctaccatgtattgaacacatacaatgtgccaggcactgagtgaaacgctgtaaatgtttactaagtgaaacattcaatacccatggcaagcctgaaagatgggtaccattatgatccccacttaacaggtggggaaaataaggttcagaaaagcaaagtaacttgctcaaagtcacaccatatgtaactggcagagctggaagctgaacctggagttgacttacatgaaaatccaggctcttaaccgcaaatactacaaatgcttcaatatgaagcaatattcaaaacataaccctcaccccaacccccacctgccttcccagcctcaaattctctcagtatctccctgatggcaccttgggcttccaagggagccatccaactaaccgtcatgttcgggcaaccgaagaagggagtggcaggatttcctttggagacttctggaattagacagcagtttaatgcaagcatctaaattctcttcctcccagagtctcattaaaactacagtaagagtttgtgttttgttttgtttttaaagacaaaatcccaccaggatagagagaataggagaggagataacagcatcataatttatgaaactaaaatgcagatagaccaggattaactgactacacagcaccaaggaagctgaatcacaagacagcagaggagaaaactggaaaggatcgtggtctatacggcagaatcttcccaagcctcaggaggaggagctctagatgttcccagatctgggaggtaaagtggaatggggggacatggtcagcgtaatggggttgggctggaagctggttaaggagcaggcagatctctgaatcccctctctgactctgtgtccccaggcatctgcctgtcccccaccctggaagaggtctggcttgaccctttgtctggtgaatttcctgctctgctttcctggtcctgctggccagatcagtggaggccactcacttcaccccacagggatgttctgtgttgccctacacctgggaactggaggtactggaggcaggctgtggtgagcttgaaagcaaaacacagagggcagtccaatctctttggccatatttcttctgcatatccaataccatgtccacaactctgctagtgtcctgatggtggtgggctctacacattcccgggaagctgaaggcagataatgaccaggacaggtcaacctctcttcttctgaaagccttcatctactaatggcctgggactcttcccttaaatgcttagattgtgtcttccactaaggttttttgctgttgctgttgtttgtttgtttgtttgtttgtttgtttgttttgagacggaatctcactctgtcgcccaggctggagtgtagtggcacaatctcagctcaccacaaccttcacctcctaggttgaagggattctcctgcctcagcctcctgagtagctaggattacaggcacatgccaccatgcctggctaatttttgtatttttagtagagacaggatttcgccatgttggccaggctggtcttgaactcctgacctcaggtgatctgcctaccttggtctcccaaagtgctgggattactggtgtgagccaccacacccggccaaggtttttgtttgtttgtttgtttgtttgttttgtattgaggcagggtatcactctggtcacccaggctggagtgcagtagtgcaatcacggctcactgaaacctccacctccctggcgggctcaggtgatcctgccacctcagcttcccaggtagctgggactacaggcttgtaccaccactcccagctaatttttgcgtttttagtagagacagggtttccccatgttgcccaggttggtctcaaactctgggctcaagcgatctgcctgcctcagcctcccaaagtgctgggattacaggtgtaagccaccgtacccggccccgccactaaggttttgaaaatgaagcaattacaagtttaagtctattaataagtgatgaagctatgtagaaaagcagaataattatcttggatcaggaaggtcacatgaggatctacttgggggttgtcaatattctatttcttgacctgatcagtgttgacagcaggttttaattttttacttctttttgtttgtttgtttttgagacggagtcttgctctgtctcccaggctggagtgcagtggtatgatctcggctcactgcaacctccgcctcctgggttcaagctgttctcctgcctcagcctccccagtagctgggattacaggcaggcaccaccacgaccagctaatttttgtatttttagtagagactgggtttcaccatcttggccaggctggtctcgaacttctgatctcgtgatccgccctccttggcctcccaaagtgctgggattacaggcttgagccaccgcgcccggcccattttttacttccttattaaactgtacatataggccttgcacacttttctgcatcaatgttatattccacaataaagggaaaaggtatatacacaacttgataccagtaatgtgaaacatatatttctacatagaaaaaaaaatgactgaaatactgcactccaatgtgttcacacagtagttgtttctggattatttatatattaaatgtttatatattgtattatgccatgaggtttgtgttttctctccacttttctgcattttccaagtttactacaaagagcacatattactcttataatcagaaagtcataaaatatatttaaaaagacaaaattgaaactaataaggatcaacacaaaacagatgagccatctgtggaaatccgcacagaatactacctaaagagattggtgacgtgcatgatctcactaggatgagcacaaagcttgccagagcctagggtctatttctagggttggctcttggaagccaggatagttgttatctctgggaagagggaggggcacacaaggggcttctaaaacattctgaatgttctatttctgaacctggttggtgggtacatgactgttggttttattattatatgttttatatactcttccgtatgtatggtgtggattccaaaaaaagatttcctttagagaaaaccagaatcacataagtagaaaatatggtgctatgttgaaggaacaactcaagtttatataaaatcatcatcatttataggcttaaaaagttgctttggaattttggtctaactgacttgtcttttctgcagcaaaccacgctccttctggacgtgctccaggcagaggggattagggtgggttcaaggctgcaagtacctagctcagcacactctcttcaggggacttagagtttgtctggtgttggctctctgagctcttgtcaggaatgccgacccttccgaggttcaggatttgaagcctgccttcccaccccagatttggtccacacagacactcaagtatgtatttcaactacaaatgacctgtactttcctattactcctctctttcatggtaacctttctggtatccttccttccctacatttatgggagggggacatcattctctgctctcctgtcactgaaggctccaccttctgtcttcttctgacccatctggttttcctggggccacctcctctccttaccaccctaacgcttttgtaacttgaggagaaatgagagatcacctagtcaggtcatcattctctgtagatgaagaggcccaatggtttgctcaagaattgccaagcgagttaaagacagagagtatgagagtcagcaagacctacagaaagcatctatctgcactgttttgcagggacttagcctttgtgtgtggactcctggaatgccacccactaagaaacattgtctgacaccaactccccacttggtaggtggggacactgaaactcatggcaggaaagggccttgccccaagccagggcagagtgtaactcatcactctcaattttcagtccagggcaccttgttgtgactatcccaaaggcagccactttccctggtctgaaagacctgaagagagaagagaagagaaggatggaaggcagagtatgcggctttgattcatttcctggtgaaaacagatctatccgagaagcaaatttcacgaaagggaagagaagaaagtgtcccatacgttgctggcctgtttcaaccttgctttgattcttgctgaaaagggtaccgtgtatttctgagttcaacatgcagaccagtgttaggaaagccactgcacctccactttagcctccagggctgtgccctgcaaatggcctgcagccttggtgcctcgctctccagactgcattttggaagatgggacagaggcttatggaagcccacattagaacgggggagcagaatgggtgagatgagggatccttgatagtgaaccagatgaaggaatggtagccaaatgccaggcctcctttgtggcttcaatccaaaggctctggagcccttccagggcagaacatcaggcatgtttacccccactgtcctcaacagtgacagaggtgcaatcttgggcagctggccattttgaaagcaacctccttaatctcaactgggaaggctccctagcaggacccctgtgttgcacacctggaggaagctagactaaccagaagctcagcacggttccatctgggatgcccaggtctgagacgaaaaaggtaactctcttttctgggtcctggcccagttgtgtctctctccacctcattctctgagatgcctgtctccccttttttgtcccatcaggaggcaagagctatcactgggccagactccaccagaagccaagccagcttgttacccagcttctcaaggagcaaagaacagccttgtttctatcttatccccactgtcccctgcccctgccccacctcccagccattcagcttctggcttccccagagctgcctgcttctttgtggtcctccattccttgaaaagaccttctagtcattagtgtatataaatggccacttagcccagattacagtgaggtcaacagctggggctctgagaattgtcacacactggcacaagagaggaggctattcttccagagaatttggagggcactcccatccacttacaacaaaaagcccatccactgtgcttggcagtaggtgatctgagaaccaatggaaccaggttaatcctgtggcactgttgagtgaggagagcagtggcgggcactggaaaatatcagagacaaggcaggagacctgaaatctaggcttagctcctcatatacttggcagctgtatgacctcagacaaccagtgttacctctctaagcctcagtttcctcatgcaaaaggagggggaataacaacggagcccactgcttgggggtgttgtgaggacaggatgaaaaaacaaacagaaatccctcagtacaggattcagtgcagtggacagtcttgcaaggtccggttcagccctccacccctaccctcaccagtataaagaactctggcctacaagtcagatgacctgagttttaatctcagctttgccattagccgtgtgaacttgagaaagtccctttcctttttacatctattgagatgatcatgcattttttgtcctttattctgttaatatagtgtgttacattgattgcttttcatagactgaaccagccttgtattccagggataaatctcacttggtcatggtgtataatcctttatacaaatgttgctgggttgagtttgctagtattttgttgaagatttttatgtcttgattcataaggaatattggtgtaccttccccttttatggccacagtttccctacaatgatgtagtcgaactagacaacctccaatatctttcagtattcatgtcctctgattctgtgaaactaagaaaattaagaaatagtgattcataggcaccaggcaggcaaaacttagactccttgtagaataattaggaagccaaatattcagtgtgcttatttctcaaataaccttagtttctccagtctgccccaactccgaggcctgaatatctctagatgcttatgatggcaactaaagcctaaaagctaattcattttaaagttcttccaaatgcatagggttttatttttccagacctgggttcagatggggaatttgacaaacaatggaaagggggaaaaacaacaatctaaacactgagtgacaaagtaacaaagaaatagtctagctatcagccagtcaagccagccttggctttgttatccaaagtagtcagtctaattctaccaccagtttctgttcctgtagctgtctactgcctgccagggactctgccttcccacccacaactaccaatggaaggatgtggtgaccataccagtggctgctgacatctcctgccatgggaaacataattgcctccagcagcctcccccttagatccatcatttttgctgcacttggcctgggctgtactcccggccaatgactgaacatggtgagcatagtaatgcaggcccatttctgtgaggagcaggactcctccagtaggtgactttggctcaaggactctctattggcctggttgaacttttcctgaactgtgctactgtctgagactcttcttacccaatcctctttctcgccccaattgtcacagaccacctgcattgtggtctgagtctctccccaccttctcttgctcttccctgtttatctttcacaggcatttcccccagtacattccttgaatgtctaacccgatacgggtgcctgacttttggcagacctaagcagacaaaaaggagtacttggttacctagctcttctttctaccacaaacatcgagggaaccctttttccctcacccctctgccacacccccactgccccagtgaacaaccacagagagagctgtggtataatattaggctggtgcaaaagtaattgcggtttttgccattacttttaatggtaaaaaccgcaattacttttgcacctacctagtatttgtgtccccccaaattcatatgttgaaacctaacccacaatatgatgtcattaggaggcaagaccttgaggaggtgattagatgatggggtggagctctcctgaatgagattagtgcccttataagaagaagcccaaggaagctaccttgactcttccatcacatgagaatgcagcaagaaggcaccatctactaatcaggaagagagctctcaccagacactgaatctgccagtgtcttgatcttgaagttcccagcctccagaactatgcataatgcatttccattgtctctaagccacccagcctatggtattttgtcatagcagcctgaactgactaagacagtgagccacatgagaagtgccccaacccctcccttaagcacttggctcacagatcagtgggttcatttctgcctgagttttattgttattctgtagatttcttgggctagatatatttttctgttattttccttcttcacctcagtcatgaattggttgttttaaaaaagacaatgtaagtcatggggaaactcctgacaactctactctcctagggttcctgataaaaggggattcagttgagtcctctgatggtctctacctgccaaagtccagcagcccttagcaaacatgctgctcgtttctgtagagaaggtgctggtgtcccaccatacttctctctccctcatgaagggcttgcgacccagcaaatgggtggcttatatgggtctgtttcaaaggaagagccagctctgggaagaaaaacgatgagcataagcataacctaccactgtgcctgggaaagcagacaacttttttgatgtgtgaatatctaatgagaatggaatccatcaattaccttaaacttaggcacagtcttcaaattcaatatatgtgggatatacttttagtcagtttgtagacgttatttgtaataaataatctggcttctctaaagaaattattttaagtgtttggtttggtttgatttaatggtaaaattatatttagtggcagagaattatagcaatggtgataaactatagagtgtcataagttcatatcttattctcacatttgaagctgcctgcagatgcattcaagatgcagccagaagtcaggagactcaggctgttatttggagctcatcattttacagccttgctggactcccactttctcaggggaaaaatgtggtgttgacccagattagctctccaggccctgctgagttgggcactctgtaagctggagggtcttctattgtcttcacctaagtgtcaatcaacaacccaaatgggcatgggggaagagggagctgggccaatgcccagggtgcctggtagagagataccttgggcactggaaggcaccagcttcccagagagaagggggagggccatgaaaaagttggctgtagatgccagggacactgggactctccagctgtgtgtttgtgtcttctgaagacttatgtttcattcctttggagcatgcataatcatacactgtgggatgtgttatatagattgcttgatagttcaccactgtaataaaatactgtgactggaatctgctcccagtctgcctttgatagcacttgtgcaacacacatttactgagcatttacagtgatccaggacctgtgttgtgaaaacattgatggacaaggcagatggtggagcacgtcagtgaggatttttaacaaaggctggtaagtgctataaaggaacattgtaggacactagagaacaaagaacaggagaacctgacttaggctggggtggggcgttggttagaggaggctccttggaggacatgaggtttaagctgtgacctgaggatgaatagatgttggccaggtgaggggccctggggaagaaagttggcaaaattcctaaaccaacttgatctatgtcacagcttcacccagtgctactcctattctaagacccaatgaatacccgggtcacatagggagaatgcttgcaaaatgttggatgtccttgggaaaagagctgctttctgcagtcacgtggaatcatcccacagaccgctgtgctgtagtagatggggttggggaggatgggaaagcctttatctttctgtttctaatttcttcaattccagaaaatttactttcctgaagctgtaaggtgtccttcattttcagcctcaattgttgaaaattagattacaaaccaaagcaggaattccatgatatgtttttaagttgttcacacagtagagttgggtgtgtcccatttataaaacaatccatcataagtcagtatagagcagaagagatagctaagaaaaatccctgagtcctaaatgtcagaatcagaagggcccataaggataatctaaatcagaggttctcaaagtggaagggcaggggtgtccttgtactagcagcagcagcagcagcagcagcccctggaaatctattacaaatgcaaattccagggccccacctgtatctgtggagtcagaaactctggggatggaacccagtaatctgcattttaacaagctctccaggccacattccaatgtgagaaccactaatttaatccaatcctctcattatacagaataggaaactgagtctgacccctggtcaagccttgctactgctgtccagcaggatgtgatatggatgatggatcagtgaccaccgtgtgctgctttccaacttcctctttcccaattgaaatttttttttctttttattgcactcttactttctatgccaaggtgagcatggtgaccagtggtccctgaaacatgaagagctatatactgaccaaattcagaggatgacacatcacctagggtttccggattggagttggatccctttgggaaaggggtaaataggttttccctaagtgtgggcattttgggaggtgtatgcgtgggaaggaaggtgtgtatgaatgaggatggccaagagattgattgcaacaaatactgttggttgccagcactaagtcttccttctcttgacacctttccccattttcatttaggcagcttcgtttggcccataccacctctgtgcttaggaggaacctggctccacacaaggttctagcgggggacacagctgacatgaagcagcacagtaggctagtaggcgttggatccattcagactaaaaagcatgaaatctgggggggcttctgggaaagaagcttcctggctcttctgacagagattctagaagccattctcctgctctctgaatggggcaggaggaaatttgtagcctctggagttgctggcactatcttgtgcccacaagggggagccagccttaggatgaggctcatgccactgaaggcagagtagacagccagaaagaaacagcatctttgatgacactgaggaactgttgattcaaaccaaccctgaagtccacccaaccgctggactttaactttcaggaatcagtaagtcccctttattgtttaagccagtgtgaactgcgctgtctgctaattgggactgaaaacatcccaactgataatctggcctggcctctcagacccctgagttcatgaggtctgctttacacagccagcctcatattaaaaaacacccgatttttaatgatgaagcttggggcctgctgaaccctgctcagccttgagtcatgttcttttatctactgaccaattcatttacagagacaaatctaacacacctgaaccatctgtacaatgcactctagcaaatacattcagtatggatcaaatatcacaatcctgggctcttcattcagatctcaagtgtggtactcaagatcttcaatatgcattagttgaatgtgatacacattttagatacaatagtctagcttaataacattaagaatttctgggtcatattcaattctgatgcaaactagaatatgtactttgtgggtttctgtgaagaaaataattgatgatttaaaatgggattcatctatagaaaagaagcaatgctagctcataaaagcaattattggcatcaaactcctgaatttttaaatcccttaaaaagtccaagagcataccagaaagtcaagatttggtttcaaaggtaataactgtaaacaaaaaaattaaaagcccgtaaaaggtgttgctgggtaggattgtgatggctctagaaacaattgtgagcgctcattctctttctcaattcctagtctaatattatttgaaaaactttatataatgagagagtgagaaatagacacaaatcaagttcagggttacagagcaatgcttagccttcaggaacctcttctctgggggaaatttctgagctggagttggcttggacaatgagctcgggcaggacagatgggggatgtggctgctacccttgcaagtgggatgtaggggagcaggaataaagtagattgtttggaaaagaggagctttcctctctactgggacaaatgtacgtggagcatttgatcagtttagcagagccttacttacccagaggccctcactccagtgctctgtgatgagttcagaggccagcagccaagataggggcaaagaactgggggaaggagggagagttagtgggaacatcacagttgtcttcaaatctctaaagggctcttaaaccttggggggtcatattgtactagaatgttgatgaacctcaagatttgtaatttgtctcaaaagtggggcatggagaaggattctaaactctaaactggatgtcaatctagctctgacaaatcacaatgcagactttttgtttgcagcagggacttggtgaagtcttttaagttcctgagaccacgttgtcattcagaaagccaacttaaacaattttattaatgaatgagtcctcggttgtaatcttgcctcttgcagtgcagaataactacacggcttggaagagtggttctgcccaccagctgctgtggaacaagctgggcagaatagatctacatgattccagatctatatgaatgcacagggaattgacatggtcaaggccattgccagaggctgctctttcaaccccattctgctgctttgatctgtatcaatcttgaactagggcaattcatagagcataagggagtcaggagacctttctgggtaggtgggtggggaaagggcctccttgtgatgtaattattctgccaaagcagacatttccaaattaaaagtcaacaaagcaaacaaaagaataaaagaaatgattaaaatggctatcaaaatgataagaacaaataaaaacaaaaacctaaaaagataattctcacaaagaatgtagaatctgtgcttatgagctagtaaaataaacctcttttttttggtttaaaccagtagtgggagcttgttcatatactatcaagtatttttataagtcacatttaagcctaccaggagaacatatgcttaacagccttccaaaaacgttcactttatactgtgctagtcataaagaaatagcagagttacaaacacactgtgtgtaagtgaagaccactcactgctctcagaactgaccaaaatcgattggcttatgttaggaatatcagcaccaccccaaagtggtatgaatgaatcttaatcagggaaaagtaataaaatgagtggcctgaatttcgaaactagctgtttttggcttttcttaccatgtgaagctgtcactgtggtatgtgaaatggcagccagaagttttgttttgtccttgtaaattgcattaaatgacgacaacaacaacaacagcagaaacaacagaaccaccaggacaaattaccactggcggtataaaattgtgtacttgttggaagttgaagaaatcacatgttttcagacattgcacaagtgctatagaaggataaggagcttaactggaccagagaaatgcatcatggtcagtgggtaaatgggccctacatgcagatgcaaagttctcctttctgcccagtgcaagaatatgggttcatcggcctccaagccttgaagactgagagtgtctatcaatacttcctctaaaatgctcaaaacagtttccaaaacttagcattccgcaatggctagcagatacagctcattcattggttcattcccctctatattctactcattcattccaaggatcattcagcttacattacagagctagcgaagacgtcttcctatgcctgaggagtttactaccaagtggagaagcagacaagtcacaaagaactctgatgaagaagtggacatcaccacaccctgaaaggcagaaaccagagatcttgtgagctggagcatgagcagggacacaatgaccaggtgtgaactttctaaaagtcattttggcattggtcagaggtgtcctactttgtgtaccagtgtcaaggccttaggagctggttctccctgtagttgagaaccgtaacctttttcagaactctattccaaggcctagcacttgctctagagtgacagtttgcacagaaagccagtcagagatggcgagtcactagcagcattctgtcggctcctgtattactcagcaaactgtgagtcatcccggtgtttccagacttgcagatataccagagagctaatgaagcaagtgggtttctcatctcattcagaagcagagataatgtccgttcttgtttacagtcacttctttgtttcccccacctacgtattatcatttctccaaaatgtcaagagagggacagccattatgctcaattttccaggaaagttatttctggttatgcctgtgcatttaacaaacatgcacctcagtaagacatacaaaaaacccagatggcccatacaacatgatgagtggatgtgcagtaaatactgctcttaccagggatggaaaatgagcagttcagcttgctgcttcttttagattgtacactaatattattgcaaaagaaaagactgcttttgattaggagaggactagcaagtgttttaaaattgcagcctttactttttcattgtggtaaaaatatgtataaaatgtaccattttaacaatttttaagtgtgcaattcagtggcattaagtgcactcacagtgttgtgcaactatcaccaccatccatctccagaactttttcattttcctgtactgaaactctgtccccattaaacatgcactcctaatttcctccctcccctagcccctgtcactcacagttctatctgcctttctccatgaattggactactctagggacctcacatgagtggaatgatacaatatttgtcctttggtggctggcttgtttcacttagcttaatgccttcagtgatcatccatgttatagcacatgtcagaatttccttcctttttaaggctgaataatattctattgtatgggcatgctgcattttttaaatttatttaccagctgatggacatttgggttgtctctctcttttgactattgtgaacaaaactgctatgaacagataactggttgagcccctgctttcaattctttctttctttctttctttctttctttctttctttctttctttctttctttctttcttttttctttctttctttcttttttctttctttcttactttctctgtctctgtctctgtctctctttctttctttctttctctctttctttttctttctttctttctctctttctttctttctttttttttattttttgagatggggtctctctatgtcacccaggctggagtgcagggcagtgatcacagctcactgcagcttcaacctcctggtctcaagcaatcctcccacctcagcctccggagtagctgaaactgcaggcaacgccaccatgcctggttaatttttgtaattttttgtaaaggtgggatctcactatgttgcccaggctggcattgaactcctggcctcaagcgatcctcccacctcggcttctcaaagtgctgcgattacaggtgtgagccactgtgtccagccttgctttcgattcttttaggcatatacccagaagtggaatcactggatcatacggtatttctctgtgtaattttttgaggaactgccgtacttttttccacagtggctgcactatttcacattcccaccaacaatgcacaagggttccaatttctccacatcctcaccatcacttgttattttctctctctgtgtgtatgtgtttataataaccatcccaatgggtgtcaacattttggtgtttgaagatgtgaaactagaaagctatagtggagtgcattgtctgttcacattttccagagctcatctttgaaaggattgccagataaagggaaagggtcatggaatcattcccagttattcccactcagggatgggtgagggcctcccacatcgttcaaagctttgtcacatggaaataaatgatcattaatcacaattgcaaatgagtagtccaccttcatctgttggtctgctgagccagctggctttggcaaattctcttcatgggccaccccgacatgggcctgcagaagaatatgtgtctccacagctacgctcacctcctctgctcaaaactggaagatggccggatttggtagcatgctacaggggaaaaagctggccggaacctgagcctttagctgcaaactgaaagctcccacaagcaaagcaagaggtgggataattcctagtgaggtacagctatccatctttcaggccctgaaggccacctttagcccaggactatatatataatgtcctggagcacccacttttatttttcctgtgcacctagctccaataacccagccaaggcctgtggctctgtgcttttcgtctgtgtgagtcctagctgcacgttaccaagaaacttggttcacatggggtaaaggagaaaacatcgaagaaatggatgaatgctgactctttattccactctctatcttagaaactgttgctgagatgagagttaagagtcagctgtctgaagacacctgcagaggtgagcctgtgggtgaggtggggtgatctctttgggcctttctgctgcttttggctttcaacaaccttactgctttggatgggtgcagccggcatgataaacactcatctagcaaaaaacacaacatgataaaacaaacaaaagcagtgtttgtcattgtaggcaaaataacaaaatcagataaaatcccagactgtttcaactccttaggaaaaagcagaaactttcttttggatctgggagcagggtgctttaaatgtaaccagcattctaccctctgctatccccttcaagctaaaaagcagccaggtcaggccccacatagttgttttacagggcaggcccagatcgtgggatttgtcaatccctaagggacagaacaggctaaaagtacaaatagactcgggaaaggattccataaatccacgatatgggaccatgagtggatctgagagtcagaagctggaagtgagagtcagaagtggatctgagagtcagaagcacaggatggggaggggagggtgcagtccagccctctgagtactcatcctttgctcacctggatggaagggtcacgtctttgattccccttggcgctctgcaccatccactcctgcactcagtgacagtgctggctgtaggtgttagggccacagctgaatggagcaagtctaccgtgagtttcatctgctctagatcttgtttacattttgcgaacttttcacctggggacatagtagtagtagagcgacagcacttctctttcatgtttgttgtgtgcgcaaaactggactgctcgctccatatggtgttctgtgttttgggtttgtaggtattcataaggagatacagcttaaagcagcacgacacaatgatttatttctgtcctcttacgttctttgaaaagcgcaatgagattccttgccttgctttacagtgacaaataagtaggttgtcttaattaacttagcataaaataatttgtgcacttcatttttaaaagggctcattttgggtgtcctaacttcagcaagtttccttgtttctcttcagatatgttaagacaaaacaaacaaaaaacaaaacaaaaaacttgacaggaggtttctgaaaatgattgcctcttcagctttcataagccagttactaagcaatgaaaaaaattgtatctattgatctctactactgatgcatcttaagtaggcggccttgtgcatccccgtaagttttggggttgaccacactaactgatggctcattcctccaggggaacaatgtaaagtcaccttcatttgaaagtgtcgtctcacttattctttaacttttaatagaaaaaaaatgttgacatttaaaaggttagcatttaacaagcagctcattttaaatttccgctttttgaaaaagaaaaatagctttgaggtggaggatcactaatggcccttagaaaccgaaaaagaaactgaaaaaaaaacttttttttgattcttggtaagattaataccaagttctaagcctgtgtttcccaaattcaacagcccatgtggtttcatttcctggcaatttagagaggttaaaacaaaacattttcaacactgagatatcggtccccgaattttcaaaatgcatgttacacggtgtctaatcatagttccacacaaaacagctaagaaaaagtttcccgaaaccaaacagctctttgcagcttaatttagaaagaatggtaaaactaagcttgtatgtaccatcatgtttaaatacaaaataagaatgctcattcaggaaaacatttccttgtctgccagagaatacgcacagggcaggccccggctctgacccacgggctctttgaaatctgcctggtccccagtcctttatctggcaagtggaggcacttccttacttatcatttgactggtggacaacacagagattcctctagaggcttctgttcttgcattttagcaggactaacctttgaaataaaatctgtgatgtttctcgccagaattagtaaaagacaaaatttctctgagaacacagacagcagtattgctttcccgcaagccttactctcaaaacgagagaggaatgcagggaagtgagggagaagacctgtaagtccaaggtgacaggcccttccttgaaaatatgtggtggatctgattttggggtggaggtcatgtattttagtaatataataattactttttgaaaatgttaatgagtgattctgagactaggaaaaggctcacttgctgtctctgcctctcctgactctagttgtaaatggagcagatgtaactttgatcagaatcggaaattctcttggcctcactaacctggtttgttcctttttgttttccatgaaaagtcatggttcaaatataaagaatttaatttgcagagctaattgagacagcagtaattaaaggttatgccctactgagtgggctagtgtagccttggaagttcaaaccaaaaggaatcttgggtttctgcaaagattctttttggaggctttaggagtgagagtcagtggtgcagaagaaggacggaaacgagaggagagaggggaggtatcccctcaggatgcgtgctctgtgcgccatgactatgcaggaccagctttccttcctggccactcatgtacacgctttccgccctgttcattgtcactgtgtatcagtaagccctctgcctgagtcttgaaatgtcaggcacccctgagcctgctgcaagcaggtggggtcagatccacgctggctgcaggtggaacttagctcctccttccccctcctctctgcccacctaaagtcgtcctgtggttgcatttgttattcagcatccatgtaactcctagaagttcagctggccgtgcttagagggaagagaagacaacattctcccctacccacggtcaggggcactcaggaaaccacagcctggcttggcggctctacttccttctggagtcaccaacctgtgtctgctgccttggctgctcctcagccacctggcaaaagtcttccttaacgcccctaagggactgtccgtgagcacgcagccccagagggactgagctctcccctgccctttctctccaagtcaccgtccacccctgggggtcagagaggagcctggatgctgagccgaggctgactaaattcattccattgggttactggtgttctgggtttcgggaactttcctgagagtgacagctaatatcaatggagcataattgtgtaccaggccctatgccaagcgctgttacctcatctcatttaatcctcacagcagccccatgagataggtatgctagtatctccattttacagactgaagcctggaaagggtaaatcgcttgccccgcggaaaaggtggcagaactgggatttggacccaagtgatccaaagtctgagctttcttgaacttggccttgagcccagccccagggcctgtcccctgccaaggccccagggtaaggcccctgtgtcccccgccctgtgccatctatcttcaggccctgggtgctggaagtactgcacttcggagggttcagtctaccaggggtgagagaggccacaggtggggatagtgggggcttccccaaggccccactttagagggagctgcccagatcctcttcataggcccaacccctcagaaagggaagatggtgagttcactgcctctgcaattgcctggtgctcacgactgcctaagctaaagcttatccttaagatagaaagcatatcagacccagtaggggcttaatccagccttctccaaggcaggtttgattcccccttctctaccctctccatatttgtcaaaacaacatcatgtgcctccttggtctatttctccacagctgccctcttccctctgtgctgcacagcctgcctcaaggatcagattccaggcttttttttgttcttattccaactggcctccatccacatccctcctccccatgaaaccacactcccagctctgcagatctgagtggggctcaaatgcacgtgcactgagggcactctggccagaggctgcctcttgctatccccagtcttccacagtccaactcccatctccttgacatacttgtttgtgtctttgagtaaatgtaagatctgttctgcagtcgtgaatagtgaaactgaagtaagtcctaaccgcgatttttgcaacacgccaaggtatctccagtaatctgcagggagaagggacatcagatgatgcaaacaaaattcattttgcctcagtctgattaaacatcaagatatatcacccagcctggagggagggtggggaattcagtgacgcaatttggggtcattaaaatctgacaaaccagtgctgggtgttgcaactccataaagagttaaagatccctcccttaataattccaggtccacatcccttatctgtaatttaaagtccaagaagctctgaaagccaattttacttttgtaaatttggtgccaaattttatgtgggggcaaaagttgactctggacttccttaaatattcatatttctctgcaaaagtaatgaaacactgcttcagattacactggagggttgtgtgacatttggtatttgcaccacattaccttcccaaagtcccaaatgttctgaatttggaaattcatcaggccccggaggtttcaggtccaagcccacaaggctgccctagccctgattgagcctgtagtgtgtgctgggcaccgttctaagcagtttcaggttagcatctcctttgccttcccaatgccctaagtgaaggggactattcctttccccattttcagctgaggctcaggagttgagtaacattgctcatgggacctgaatcagtcagcatctgtagccagacttgagcctcagttctgtctgcctccagtgcccttgcttgctcaacctcccatgctaaacagctgccccaaagtcatgtggcatttgccttttaccttacgtggacatgaatggtgcattgaaattgaatagttcactcaactggtaaagcaaaatcctccaaatagagagatgctggtctgtacataaaaatgagctcctctatagaaggctggatttggcttttcagcttactcaagcgtttgtgtctcatctcacatttaaaaataactcctttagaaaactaagatctagaccaggtgcggtggttcctgcctgtaatctcagtgctttgggaggctgaggtgggaggatcacttgagcccaggagtttgagaccagactgggcaatatagtgagaccctgcctctaaagaaatgaacagacaaaaaccaaaaaagcccccaccccccgcacaaaacctcaaagatccagattcaaatgaatgtccagtttttccatggtaaccattatcgtccatggcaaatgtaacaggctagtaaatgccatatcataggtaattagtgttcctgaggctcagcttggccatcagtaaaacttgggaggtttgcttagcctgctggaagtgggaaatatgttcttccccaccattggggccaccatctgtccttctacagcggtcccagctcttgcctcaaacactcgcttttttctttatttttttctctcccctggaagaatgaccagggctgagttcttaggtcttagagttaatagggagaggccataagaagaaacagaaggactgttgagattcccccagcttggaggcctggaagaataccaggtagagaacagagtgctagggagaggagcggagtgagagtgccggagagctcaagaaagagcaaagtgagatccccagtctgcaaagcagggatggacctttcccctttcccctttcccatcaggctgggagttgtccaggagaggcagggcctagagcaaaaggagcccacaaggctcagaggctgcacaactcctatcaatctcatggtgggtacagggtctggagataacgtggcttgtgtctgtcctgccacagctactggtttttagaaccacatcttagtcccatgaaacagatctgggagcacagggtcaggaggtagagtcatcgtgacagcaaatcccttctcagcacatactttatgccaggccctgttcaaagtgctttagatgtattaacacacttagtcctcagacaacctatcatcaccttgatttgtagaggaggaaacagttaagaggtgacagtggaaacagaaggctacagaggcagtgccccatgcatgggagtatgagtgtgggctctgtagccagattgtctgctctggccccagcttgctgtgtgactgtgggcaacttcggtcacttctctgtgcctttccccccaactctcaggagaatggtaacagcccctgcctctgaggattaaaatgagaagaggcaggtgaagcaccaggtcccatgcctggcccctgggcacaggccagcatgggctggaaaggcagctcttggtggcaatagcatttccaatttggggacccagcttcttgcctctgctggcaaaagtcgcttgccccctttattgtgctcctagccccagggagcttgactgttcggtctttctcctgaacactttctccaaccccacctaggtaattggttgggtatgatttgcatgaccccaataattaagaattctccctctgagccagctgatccagctctgggacaacacaatcagtctacaaaaatgtacccaattgaagacaaaacaaaacagaaaggctcacaatgttagacggtgacacgtctccaggctgaggatcttgcctgctagtgaaagagttcccgtgttgatgctggggcttcaccgagctagctgcagaagtccatgcaaacagatggcaacagccctataataaaatcaaaccaaagtgctcctgaactgcagaccagggcccgagccccaggtggcctgccgtgtcctatgtgctttgcctatctccacaccgctcccccggccacccccatgggagctctgcttgccgcatggtctatcaaatgaccaactccctggtgtcaagcactctgcatggttatgctccaggaaacctggatggaaaagacacaacctctgtactctaggggttgccacaggtgtgctcatacagagctcttaaataagaggtcagcccttgacaggtgcttcccttgggccaggtctctggccaagcactttataatctcctccttgaccactctccagaagagggaggcacagtgggaaatggaagtactgaggacagtcatggaaaagcttcctggagggatggtgcctgagccctaagtagctgcaggtgttggacaggagagaaaatgtgggaagggatgaccaggcccagggaacggccagagtaaaggctgagaccagatggcgtgggccaagtgctgcaggcacttctgggtaatagaaacaaagtgcaaggcagggcctgatggatgctgaagggcccaggaggctggtggggccagcttatgggcctctggggacttctgagcaagtgtaaaacatgatcaggtcactgttttagcaagacgactcagagcaatggatggtttattgggagagaccagttaagggtcaactgtatgagttcagataaagaatcaagaggacctgaacttgggcaaggatgagaggaatgggaaggagggatggtagatggtgactgagtattctgtgtaggcacacgtgtgacctggccccactgaaccctgcctcctggtatttacaccctcatgcaatctcctctggcttacatctcatgaatagaatacagcaaaagtggtgggatgttactttctagaccaggtcatagagactgtgacttctgacttgctggcactatccctcctccctctctccccattaccctgcttcactggcacactctctcatgctcactcagatgaagccagctgccatgttgtgagatgctctgtgaagagaccgtgtggcaaggaactgagggaggcctctggccaatagctcatgagaaaccgaggcctcagtccaacaacctgcaaggaactgcttcctgccagcaaccacatgagtgggcttggaagcagatccttccccactgagccttgagatgactgcagccttaggagatactcagccagaagactcagttaaaccatgccaggattcctaacacccagaaatcaggatgtggtggtaacgtatgcatatggttcgaagctggtgcttggggtaatttgttatgcagccacagataactaatacaggcaggggtcacagaaatgaaaactgggaactgtgatagacacgacccaggtggaatcagctgcatttcatgattgaaaagcctggaggagatgagggagggtgagaagtcaaaagtaatttcaagaagagcacaggctctggagtgagaccacctggcttcaagttcctgctctgtcccttgcgaactatgtgactctgggcaagtctttcaactctctgagcctcagtttcttcatttgtaaaatggagatgatgagagtgactaccttgcaaatacctgtctttttcctttcacgacctgactgagtatccagcacagtgacaaatggcatgctgaggttgctcagcaaaagtttgctgtggcatttctagaaggctcagtgtttgtccttctgccagcagggataagattaaatgcttcagtgcaatttccttacatcttaagaaggattcactagtctttctacatggcccagtgcagggaaggcatttctgtattcggacttgtcccacctggctccttccaccgggagcaccttgtgggtgcagctctccttctagggaagttaggtgacttgaacaggcactgaaaccataaccttggccttattaacactgtgcttttaaccacacaggattagctgacttcagtagactttttcagagtcttttccagtctcagagagaactatagcctggatttaccctccagagccagatattggcaacatgaaacacagttgttacttccaaaacaaaagaacacagccagatatgagattgtcttacctgtctgggcagagcaggcatggaatctgaggccactgatcgctgaaaacgctggggttgctgcatcatctgctgcagaaggaatgaagaatggtcaggctgctgctgctgttgctgctgctgctgctgcagctgcaaggtggcagtggccgtggaggaggcagtggctgaggaggcctgcgttggtgtcggctgctgcaggtagtggagcagggaaggctgcctagaggtggtaggcatggagggcatcttctggggacccggctcagaaacaaaatgggacaagggcttggtgttgccaaaagtaaatggctccgtggctcctgggctggagcttgccatcccctgctgcatgatcatgctcagggttttggatgagttgctgcttatgggcttaaagatcacatttgcttgctgctgctgctgctgctgctgctgttgctggcttagaagattactggtgggagtgaggcttcggatcagggaacactgtggggtgaaggactgctgtggcaagcctgggctagagagcttctctgggcgatagggtggggacggcccagggttgctggcaggcagagcagacatcaggtgtccttgaggggttttgatggtagaggacatgaggttggcaagaatggagctctgagggccgaactgcggctgttgagtgagagcagggctggggagcttctcaggagcatagggcatggcgggccccagggcagcattgctgctggacgtcatgcttgacagtaaggcattgggagagcctcggagagtgctacccgacaaggtattggacgacatgcaggacaccatgaggctctgggggctgaatgggggtggtggtggtggcagtggcagcggtggtgggtgtggtgatggcactgggcggtaaggtggagagagtcctggaggaggcagaccagaccaactgggggtgggcccttgctgctttgtagcagacccctgcttgctggctgccaacgccttcagctggtgggcgtgatgccactgaggcactggtaaggggggcagagcgacagggagcatggcctggacctggctcttggactgtgccattgaagaactcggtgacactatctgcttactggtggaaggaatcgaatagctgatccctgtggaggaggatgggatctgaagtgacatgccagtaacttggctgcaactagaagcaaactccttgctggaagccaggctctccaagtgtgacatctgaaccgaaggcttgggagttgtgcttagggttgcctggggatgatctaaaaccagtggctcttctggcttcgtccccagtatcttctcaagatctagctcatttggagaagggtcttgaattttggtgagctcctctagcagctcttgaagctcctggtctacagccggcacgctgttgattttctcatagtaaggaacagtgggccctttcagtcccacttctgtagtctgtggtactacaaatggtgagcccatgatgttgccattcatagggttattctccagcagtaatgactggccagccactcccatagccgcagggctaggatttattgtcaatggagggacctgcagttctgcacaagcagtactaggatgagcacctgggcccattgcaagggtgacatcttcaaggcaaggcctcttaattttattagggtagcccccatcagccatgtctggaaactggaagtggtcttcttcttgtctcctcttaacagttccctgtgaatggaagagaagagaagaggagaagagaggagaggagaagggaagagaggtgacacacacacacacacacacacacacacacacagagagagagagagagagacagagagaaagagagagagagagagagaggaatttttataaaggtttggcacattaaagctaatgaacaggaaatgtgcatgataaaacagacctctcagtttaaagacttatagttgtgaaaactataaaatacagcctgtctttggaaccatagtgcttatttattcattattatgtttcatctaaactgtctaattacatttcaaataaggcattatgttgtctgtatactaaaacgggatagaacgttattcaaagggtaatctgcccacttcaaggagagttcaacaaaactatgcagaagtcactaaatgaaccatgctgccaaaggcaggcattggagagaaaactagaagtagctaaatagttttaattctttcctgtctacagacacatagattttaacgaaggaataccatagtatagaattgaacttttaggctgccttctagtcttggttaaatgcatcaggctgcagtggtaaaattgaatacaacagagcccttacaggaaagaagtagatctggatgtgttttcttggggagctgtttaaaatactgtttttgggaaagcacaagtttcagaacagtcattgtaggcatcgtattcattgttccatttatttttacacacacacacacacacacacacacacacacactctcacacattgctatgtgtacacaaaaataatttggaagaacctatacccaacaatttggagtggtcatttatttgggatgactggcaattccctttctattctcttcatttctgcttgtttgtctttaacgagaacgactcataatccaaaaatttaaaaaagtataaagttatctaaataagaaattttcctctgaagatgcatcctcaggttggggagatattaaacaatgagaaaaggccccaatctgggatctgaaccttgggggagctgcccatcatttatagaagcacagcctttgggaacaaagcaaagtcactagcaatgtgagacttcctactcttcatggcttcatacagtcatccatcgctgttgtgttaatgaccatgacctgtatgttagcaggtaaatgggaaaggaagtgggggcaaaggagtatgtgcaggaatgatcaaaataaggaaaggaagagagggatctggaaatcacctgaatgccgataggtgaacaggtagaattcttttaaagcttcccccacccggtaccccccaaataacccctttccagctttggaagtttcactaggacatacagtgctcatcctctgatgtcaccttaagtttggctcttctggtttgatgagcttgtagcccactaggagctcaaggcatgcatggggccacttgccagcacgatgaggggcatgactgtcatggccaagtgaacatcaaagcagatccccagggctgtatgtctcaggccttggtgcacatcagaatcacttagaaacatccacattcctgggccctcccaccacaaactgacagcttcatccagggtgtggcccaggcatcgggagtttttccaacagctccatggctgattctcaacagaaaaccactggcccagagcaagggtggaggcagcgtggcatagggctctgaccttggccttgccactgaacctctcagagccccagtttctttatgtgtaaaatgagtgtaattatagttcttttctcatgaaggtgctctgactattaagtgaaacggggcacattgtatgacacctaatagctcctcactaactggtacccggcattataaagggcaggtatggaagggttctgggagtccaatacccttcttaaagacagagaggtctctgagacccagagaggggcaggccttacccagagttgctcagccagagggcaacaaggcccaggtcagatgcagggcccctccaccaccactcagctgcctccagacccactgccttcgccatgttgttggtaggacactgcatcgcccccacagaaggggcttgccaacttgagtgagaggacttgcacacttctttgacttttcttttgagatgcccacaatctgaacaagggcacttcaagggacagctctgtcaccaaactcatctgaggcctgaataccatgggtcaggcaggaatgggttggagaggtgtagagcaggcacaataagagggctgaggcccatgcagtcatcagtgcccactttcccaggagtctgactgggcacagcacccatagtgtccctgagctggtccatggagcagctcactaactgtttggcccacagcaggtgctcagtaaatggcagttgaacgaatcaatggacaaaggaacataaattacccaacacacagggagctcagccatttactcaatccattatggagtaacctacaaacaagccactgggtcccaaactgaaattgtgtctcttctacattctcccaaagaatccaataggttaaaaatagaaatgtatgaaatagatcaatcagggatgattgcatgtggatttgacataaggatcccctgcagggagtctgagctggcaacagtcaggcccaaagtgctgtccatgatgtctcgaactgcaagacagttttaacaatggcgaagcaatgcagaaccaggcaggccaaggagggggtgggggttggggaaaggaagggagggaaggggctgtgaggggcaatggtctggcatccctgccacgtgagcctctgaaatttgctggcagcttctatgggctcccagagctttcacttaattgttggtctgccactaacctgctgggagtaaggtgcagggatggaggaggcagggcatgaccaccagacactaaaggtaccagctggggccactggcaaagggaaggaggctgcacctctcctacatgagagcccgtatacacacaccttttccagcactcatcaactgcatcccaagcaaatggtccctgatcaattccaattctagaaaccaactgactactcaataacaaagtagatcccagcaggccgccactgctggagcggatgccacttttgctatgccaagtctgtggctggacagctgctggcatgtacactcactgactttcataaggatgcctaataaagggggcaggctcacctggcttttctcaggggtggggtttggggtgccgatagaggctgctgttttggcagagtggcaagctgcaagcctcttctgagctttcatttttcaatggacttcagtgagaactcactttgtcagaggccatgcagctccatgttttggatttcatggaatgagctttcaacagtgagcctgaagtgccctggctgaacagcaagaacaccagccaaccctaaacaaggccgaggagaggcggctgtgtttacacggaaggctcagccttgctgtaatagcgtctgccttcaccagacatcagtgaggcgtggaaatctattatccagttaattttgcccctagataaagacttgctttcgtgtcttctctttcacagtcccatgatctgttactcatctcaactgcgagaagttggctgggctttcccctgtgcccagtgccacactcgtgccttcactgggtcacctgtgcctgtggctgatgccgctgaggttttgcctgcccagactgggtgtttctgactaaatcccacagccaccattttagatcaagggcaggagatagctcactgctccggaatgacctcccctcccagaatcctggtaggggcggaaggtccccaaccaagctcccagccctttctaaatgaatctccctgcttcacccatgtgcttttctccagtctctgcggtcttgatgacagcagggtattagtcctagctgtcccacagctcctacttctttcaggcctctccctgtgacaatcagtagccactggcaggatttcctcagagcatatctcgatttgctttcagacaattagttaaaaggacactggaccccagacgtcccaactcccagccagagccctcacaggcccggcctttggtggtgaggaagggggagggagtgagtgacagtgccctggcatcttttagaaacgaattcctttctctccatacataaatgcctgcagagtcccatttcagaatccggcagacaaagccaccaatgtgatccccatgaccttataaacattcattaaaatgcatttcaaggcatgtgatggcctccccaccccctagataatgagaaaacaaaggtttctcttctgatagagacaagttcagctctgaagtcaacattatttctggttctgtctgaacaatgacatatggcaactcttccctttctatagttctagtccagaatgacaaaaaaggggaaaaatttcttagagaaggtagagattatacgaatacagtccatgaaatgagcataaggagaataaagaatataacttatccaaagaagtctggcaggctgttataaatgcttgattttggacactgtagttggaggtttaacatggacaccaataaaaaggtcagcaaagggtatgcactgttcctattgggcaagaagataggaggtcaaaggtaaccaggaaagataaactcagggagacttattttccctccagagggcactgggcttgtaggccctgggcaaaattgtcaaaaaggtgaaaatcgcctgtggtttatttagtctgctctttcttcactagtgcctcaccagttcagttcaggccaatttgctagccagttctcctagtctcttcccttacatccatactccatgaacaactttattcaatattgttacattttccccctatgaattttgaggcacctgatgttggccaactaaattagacttcaagccctctgaggacaaggatggcccccagtagactatctcagaagaaagtaatgaagatgtcgtggggcatgatggaggtagctgtagaatagataagaaaataatgtatcaggaatgggtttgaagagacaaagagatgggggatggagagaaagagagagagtgagagcgaggaggagagaaagacagaatgaatatgtttgcatttgcacatgggatcaaaggaatatccgtgtgtatagtatcaatgcctgtatttggggatgtgttatttacatgtttattttcagcagaatgtcccagcaaactgaaactgatctttctgtagaacaaacaggattttgagcatttccagaattgcaagacatgaggctctggagaataccagggtggttgggaatggcagggaaccctgaatgctaatgctgattggcttcaagaggagtcagttatgtctcaggagcaaatctctgataatgggtggtttggagcaagaacctcgacctacaaatcggggatttattggtgtccctgattcgccctgaaccagcactcgatgcaggcagatgcaggctgcggtggaggaaggggccctggaatgcacatgagaagacctgcagttaagtcctagctcctccgtttgttgtgtggctgtgggcaagccactcccctccctgaagctcaatttcttcttctgtaaaatgggtacttggcccaccatgtgtgcttcacagcattagtgaaaggttccactgtactcactgaggagagcacttggggagcagtaatcactactgatatcattctcaaggccctgtgtcttcgtgttgggcctctgttgctttcttacaaataaggatgcattcactaggatagggggatggagtggaagtagggggaggcaagcagcttagtcctgacagcactgacctgacagcactgacctgacagccagggatgctgtcttggtggctgagcctggaaactcctgcctcctgctgcttgccaccacctgccactctgaaggctgccacagtcatcagcctttagccaccctgacctgagggctggggcttcaacaggcttctgccagaactatctgagcagcagcctggagtggctggaagtgcactgacaaaggcagagatgagcaaacctgggtgggcagtgttctagaactactttctccttttctgtagtgtagacatgccagttggaagaactgacagctctaaggatgatcctcaacctatagatgtatatgaatttaatgagctcagaatttgtattgtaccatctcctgagaagaatcaaggtattctgccattgaacaagcatttgttgagagctagcctctaactcctagaccgtcagaactgctgggcccttcaagacgggctgctcacacccactcatgttaagcctggtgaggcctgtactctgttttcacaggaagaaatcctcacccagtcttccccaaacacattcccaggttctgtcattagtgggatagagatgattactgtggggagaagagaaacatctggatggatttggtgaggttgatctatagaggaagtaggtgctgcctgaggtagctgtaatagaagctaaaggtcaaaggagagggccctgtcccaatccagatgactccacttctgctggacccaggttcacaagcttaatctacatttcacctaaatttggctaacaagcccaaaatcacacaggcaaagggagaagtggaggcagaaccgaggttggaggccaccagggccaccgggcagagatcatttaagcccaaccttctcacttctccctgggctctgcctctcttaaaggaccttgtggtgtgacctcttgtaggtccctttcacactcggggcctcagtttccccactgtaaagtgaatgggtcccagctttggtaagcttatgcttacctgatgctttcttcctgggctgctcttgtagagaaaagataaatcttcttcctccatccacgagggcttctttccctgggggtgagagtaggctgaggagagccacttgcacacactcttaaagaaagtattacctgcaccagctcagtgagaggcacagatcagactgttacttgaatcaaattatgagcctccccaaatatatctatgacatttaaataggggattacttgaacatagactttgggatccggtgtggagtgcaggagactagcaaagtgaatcctgagagtagcaggtctgcacctgttggatcgagaaaggcggcctacaattctggtcaaatgagctgtgcttattgacatattctattagagagtactaccaggtcaccagtcaccagaaaggctgccagctctccaaccacctccagggaactatcctgaatggggccttaacaagcctaagagagggttggtttgggtcccaagccaatatttgctctgctttatgtcagtcatatggaacccaaaccaaccctctcctatgtgcctcaccagtcggtgcagggatcccaatttcaagtttggttttttatggtcaaagtccagcatagattaaatgaaggggtgtgatgatggtgttaaaagagaactccagaccagtttaactcttggacacacatcccatctcaccatggtgcttccaaccttccagagatgatgggctcctattttctgatgacaaagccctccacaggattgctgcctggccatcagggagtgcctctgtaactgaggctgagatcccactttcagtcctccagctgtggcccatccctgctccgcccaccgggtatggcctgtcctaggctcttaggtatggctgcattgtgaaatgatggctacagagctggcatctcctgtagtctggttcatctagtgcactacctcatagttaaaagaaatctgtttaagccactgagggtggctcctagtgccaactccaagaacaggaagcttcccttttttgggaggaggggcagatggtaacatggatcgtccaggtcaatgggagcagggcaaccacagtaagtactggacaacaacacaaaactccatgtgtggcttccatcgagtccctctccaattggtttggtcttctccgtcccatgcagcactttagcaaggggcctggctgaaggctatgaattgtgtggagcctcctcattgcagtctccaaccatctgatgctgggaaaatgtcaccaggatgcagccatgccgtgtggccaatgaaccgagaaaacaccccttttctagaatgctctaaagaggcagaataatccagaggtgaggaaggaaatactccaccagagacccaggcagttcctacaaaagccagactttccttcacctagggagtgacaagaccagtggaaaacactctcaagcagtaacccccaaatgctctgcaagccagtggcgtccagataccgcacaagcgagtgggctgtctaatcccatcatcatgatgtaaatatctctaggctgccctgggctgtgcctgaccctgtcttcagctttccacacctccacctacagcccatgcacagaaggaccacccaggaatgctgcaagtgtggcacctccagggccacccagggagaaggagggcagctatgctggtggctccaggcccatttggcgggtggtaccttcacaccacaaagcccaaactgaggccccagatttggctgatgagggcatattggacaggggtcacttatgctcttccccattgccacctggcctctggctacctggacttggctacctgtggatcctctcacaggtgccaccatcttggctgagtctccagatgcgaggtccctgaggcagtggcaggcttctcgctaatgctgatgggattaggaatgggataggtggggagggccctggactgggccctgatgagccaagtgggtttttagaggggctactggtacatttcagggacaggacatctggtagagctaagctggggcaataaggagccactgctaatctgagagctagaaacaatcagcttctgggtcattattaattagggtagtttgggctgtgtggaagtcacgtactatatggggtagccacagctctctctacagataatctctaagacttctgattgggaccgtgtgaatgcagtagcaatatctcttcttactgccaggccctgccagtcctgcctccacgccctggctggccccccttatgatctgacccatgccaggctgccatagtatgttacttctgcattagcactccttgggacctgcctctccactgtccctcagactttaaagaactatacaaacccaaggggctcttcccaagagaattgatatgacttgaggtgattccatttctggaagtagtcactccattttctgcctcactctttcagtgcttcacagagcaggatgacccaggtgcccttgtggtgaggatatttgttcaggggaatgtgactttcatcagagtggcccagataaacccagtggttttgtggttcggagtgggaaagccttcccaagagcaggacatgggattggacatggaagcctgtttctgggctccatgcctgttggattggccccatcagatcagtggcaaccttgcctgtgggcaccctgaccagggcacacaatcctctgcccaaaactcctggaatcacaagacacaaatgactattgtggtactaagcactttgtatgcattcacatagttatcttcacaactctatgagaaagatattcccattatcatcctcatcttagaaatgaagaacagagatgcctgcagtttagaggtttatcagggaatcatctccaaattggtgggggctggaacttgagtgtgagtggctagagagaacaaggagcaaagattaaagagtcttgcctgcctgtcttccttccttcctccctccctccctccctccatccctccctctcttcctttcttattcccatctttctcctttcttctctttctccatttccttttgttttagtaagggagacctgatttataagtagacttcaagagtgactttggaatacttactaagtgacaggtacagttccaaatgcattttaggctttaccttaatgttcccagtgactcaagaaagtcagtactaatgtgatcacccccaccctcattgtacagatgagggtgcccagttgaagacagggagtgtcacttgcttaagggcatttggctggctaaaaagtggtggaaccagggagtgaacttgggtttgtcagcctccagagccctgtcctcaagcagaagtggggcttggaggaaatgggccaaggtgccattcagatgatagggcaatggttgaaggagagccagagctagagaaagagagagagagagagagactataccaacttcctctacaagcagaggaaataacaagagcaactagttaccaagcctctgcttcagccctgttaactacatcaattcctttcatcttcagtgtaaccttatgaggttagaaattggggtactgagatgaaaaggcctttggtccagggcctcctgggggaacacacagtgacagactgcctggaaggcacagtcaggagacacccctgctgaacccacgcagcctccccctcctttcctggcatgataaaaacagaccccatttggattgcagtggcaaggtcaggaaacaaggtgacagtcctcctcattgccaggacaccaactagagtagtttaaatggggcaaatagaaaaatagttgctataagaacatttaagatctgctctcacagtaaatttcaaatatgcaatacagcattattaaatatagccacagtgctgtacattagattgcccaaatttatgcatcctataactgagaatttgtacccattgactgacatctccccatttcacactccaccccctgcaactcttggtaaccagccttctactgtttctatgattttaaaacagttctatgagttcagaaacaaatataactagatgaagttatggatggatgcattgactaacttgattgtggtaatcatttcacaatatatatgtatatcaaatcatcacactgtataccttaaatatacatttttaatttgtcacttatacctcaatagagctggaaagaataaagagaaagaaaaaaaacagctgctggttaatcagagccttctttcctatagtgaggtgtttgggtctctagttttgggactgaagcttttataatctggggccctctttatgaaacagaatataaaattaaaacaaaattaggtaccgggtcttagaaggcttgagggatgaactttgaagcttaggccagaggtgaccttacctctctctgtgccccaacagtaggctaaataaaatggcaacaagcttcagaccatgcagaatatttccctgcttgagaaattcaactgctatgtaggtgggagaagattccagagacacctgattagttcagaaccttctagaggggcatcctgtctatgacctcttcctgctaggacacaccaaagagagatgctgctatcaatggccacatttaaaacaatttatgtccagaacatgcctctgtagcttagcagaggggtcacatgcttattgaataagcacattttagctcctgagtgccaacttttagcctgcagagatatcgaccccacttagtagatttagagccaggctggtgagctctgatgccatgagagtcttggcatcagagcagctgaaacttggagggaacatgggataaggagtcagtccaaagactcttcccatggtctaggtcctctctttttaaattgaggtaaaatagacatagcatgaaattaactttttaaaagtgtacaattcggtagcatttaggacattcacaatgttgtgcaactatcaccactatctagttccagaactttttcatcatcccaaatggaaacccccagctcctggcaacacatttatctaccctctgtctctatgaatttgcttattctgaatacttcatataaatgggatcatacaatatgtggcgttttgtgcctggcttctttcacccggcatcatgttttctgggctcatccatgttgtggcatgcctcagtactccgttccttttgtggccaaataatattccattgtgtggacgtgccacacttggtcagtccattcatctgatggacatttgggttgtttctgtcttttggctattgtgaatagtgttgctgtgaacatttgcatacaagtttttgttgaacacttgttttcagttcttttgggtgtataccaaggagtggaattgctaggtcatggtgtaattttatgttgaactaacttcttgaggaaccaccacactgtttttcacagccttggtcttcttggaaacttgcatcattggaggtatatggaagagtagcagggagagctgggacccaaagctgatctccagactggcagagaaatctctgcagcttccttagagaagcacctttctgttcctgctgctggtctgcaccacactgtaccatgccctttgctagtaccagaggcagatgtaggcaacacttttcctatctccaggccaaatgatggcatccagaggctgagggccaagggaaaaagcatgaacaaatgcggtgaccagggagttggcttctgtaccttctcaaggccaagtgccctttcccatctaaaactgcaacctggacagtgcttggtaaagccctaatgtcctatggcagagtttggggagacccactggtcactgccatttgagttggagaggacattgcactctcttcctggctgggaatgtaccatctagcatggactgcatttgcctcgggcaagaaacttttctgaaggctttgtcttccacaagcctactctgctgcacccactcttctgcctcccagcccctccggcccagctgtatatctggaaccctgaaaaggtgagctcctcgtatgctccccatctattcagccatgcgggaaatccctctagagccatttctgggaacaacatggccagaagcagcaagagacgtgtctgcacaatgactcagcagagactgcctgtgcaacgggtgtgtacctgggaggttggttctgtatttttatacacatacaggatgcggcttctagtagcaaagactttttagggctgtatggggggtatatcatgttcatgacatgacataagcactcacagtaggctaaagggatccacacagagtctcaggatgttgtgcttttctagaccttcagatccaagtcttggtgttaccaactacaggcctttataaaatcccaggccctttcagtggacagtgtactttctcattcatcagcctttgattctaacaagaatcctaggaggtaggcagggctttgcttggggtccctgatttacacatgggtaaactgaggtgaaggagttgcaggtggcttactaaaagtcatatagatagtggcagagaagagcttggcactcaggactccagagttcagcccaggtaacagaacccccaagaaccccaggcatgtatagtggtagatgtgtggacacctcagcagtaagccagccttccccgaatgaacccagaggtaattctggggtgctaaaggaaaggcagatcacttcagctcttcacacttagactgaggataaaaaatcacttttagtttcagccacgatattttgacttgcctgtagggacggttgtatttgacccacggttttccaaaccatacatcacaggatagtgccagatagcagtgacctcagagaagaaatctcctattgtagtttctatgatatacgttagggtagcttggctgctgagaatttgctgattctcctgggcccttaatgagctctcaagtgccagggtacactgactggaccactacacactccttgcacactataggctttgtaggcaaatggataatctgattatacaaaaaaaaaaaaaagaagaagaagaagaagaaaaccttctgcacaacaaattctaatagaagaacttagcagtgtagggtgattagagggcttgaggtaggccctgagccctcatggtctgtttaaaccttgtctctaattggtggtcaccttgggcaagtcatttttccctctgtgagcctgttttcttacctacaaaatggggaaagtaaagccttcgtaaatttgttgtaaggattacatgagcttagaaatgtaattagcatagtgtgtggcatagtgtagataccaaataaatatgatctctccttctactcttgaaaatgcaaacacattcttggtggtcctaaaatagcctgtaacatggtttactcagcagcatttgctattcaaggcagatctgcctttagtcattggctgcgctcctgaacagctgtgtgaaaggctaacttttgtaaaccaaatcaaaataaaatgcagcaaaaatttgtcactgaaaggaaatcctcagtatatccttttatgaaatgaaagatccctcatccaaacttaacttttttaaaagtgcgcatttggagatatagccctttcttatgaatcctaattcaattttggccataaacacacgttgatgttccccaccccaaagcacatagcaacaagagtaggttctatattgaaaataatgacaatttaaaaacatgtacttatttcactgtatgtgtgtatgtggacagtgtctatgattgcatcatgaagtgtcatataaccatgtacgtgtacatgagagagagatagagagagaagtggtagggtggtggtggtagaggggatggcgatagtaatcatggtaatggtagaggtgatggaggtggtaatgacggaggtaagggtggtagtgatgatggtggtggtggtaatggtggtggatgtggtggtggcaattgggatggtgggatggtggtagccatggtgatggtggtaatggtgttgatttaaagggtggtggtagtgaaggtgagggtagtggtggtggaggtggtggtgctggtagcaatagtgatggtggtgatggtgttgatgagggtgttgggatcagggtgagttcccacagtatatttcattcttgttgtaccactctgtcaacagcaccactgactgggacagaggaagaaggcacactctgaatgtgttattaacagaaacctcaaaacagtctgtctccttgtagtcattcaaaattatctttttcttacctggaaaactgaaactgaattaccgggaaaaacacaggagatttttgtttgttaatatgctgccaataaagtaattttatgtcaaatttaactacaggaaagggcaaggcattttctaagttccttagatgtcatgtggctaaaaaaaacaaaaggatggacagcagttagatactgtacacttagctgtttgaagccatatattcagaaagcagatgttgggagttggtgtttgaggactgatttcctggaggtattttatataggccaagttcattgttctaaactctaagggcttgacttgagggaggaaaagaggcaagaacatgtttagttttgctgacagcatcacatgggcagccctaaggctagacaactttagggcctgaagcttattctaggaaagaagcacctacagagtggcactgggctcccctccactatagagatgaagtcatatgacagtaaagggcaggcagggctgcctagggggcccagaactgacacttccattagaatgagcacaggccagggagagaagtggggaaccagagagaaggagctggaattctagtaggacaaacggtaagtgaacaacaagaacaagttaagagtgtgtgcagtattctttcaaagactgaaaaaatagtgatgtgatagaatggcaggtggctctgagcaggccaggagaaggactgggggcagagcatcccaggcaggagggcagcaagtgggaaggccctggggtggggcttttggactgttccagtgacgggcaggcagccagtgtgcctgtcacacaatgcaccagggaagtagtcgtgaatttgcagagggtcttgcaggctatgggaaagggattggattgtattttgtttgtagggaagccatcgggggacttaagcagaggaaggattggcttcatctctttgaaaaagttctctctggatgctgatgggaggagaaatggaaggaaaagaaacacttttaggggcaagaacttttgagaagggtggaattgggagtgtggagttggggccagctttggcacaggaggggaagctaaacacgtggccgcatgagggcctgtaattctacctgaaatgggtaccatttgttagggtaaacaaatgaaccaaatgcccagtgatacagaccaagtgttggcaaacttcttctgtgatggcccaggtagtaaatgtctcaggcttcgcaggccatgtggtctctgttgaagctctgtgtagtagacaatatgttaatgactgggcgtgactgtgtgctaataaaagtttatttacaaaaacagcccgtgggctggatttagctcacaggctgtagtttgccaacctctgacctagagcatgaactgagcatcttcttggagggaaataagttctttccaagttgccctcctcacattgcagggggccatgtaggcccattattcacagaagagtgggtgggcaacctttctggagcagaaaaacgtaaagatttcttccgtagtgcaagtaaggtgaccatttctaaaccgtgcaagtgatccagcagtcccaaaagttgtttcacttctcattgtgcgcccgttctcaggtgctccgaagcttccagtcctttgtagggacatggatgaaattggaaatcatcattctcagtaaactatcgcaagaacaaaaaaccaaacaccgcatattctcactcataggtgggaattgaacaatgagatcacatggacacgggaaggggaacatcacattctggggactgttgtggggtggggggaggggggagggatagcattgggagatatacctaatgctagatgacaagttagtgggtgcagcgcaccagtgtggcacatgtatacatatgtaactaacctgcacaatgtgcacatgtaccctaaaacttaaagtataataataaaagaaaaaaaaaagagaggagagaaacatcatcccctccaggatacccttgggccttgttcttatagtcttgtacattgttgaacaatttgcatgggctagtggattaaagcacaccctccaccctcaggccctcaagggtctctatgataatacagtctcaccttctaccctttccatcaccatcctaggtgctatggccaaccttgaggctgccatgttaggtctatgcatttcccacctccaccacataactctctgaaggccaggtagtttcctattcatcttggtaaccccaaagcctcgtgacagggctcagctggcatctgcggatgtgaatgaaccattggagaaaatggtactctgcaaataactctgttattttcccatttcctgtgtaaggcctagagacaatgactttttaattgcaccccttcccctctgtatgacactggccttctcttgtgtccagcaatgtgggtggcctagatgatttctaagggacttctggccaagatgaacagcagctgcatcttactgagcatttactatgtgccatatactcagccacagctctaggggcatagaagcaggagctctcagggtcagggcagtgagtgagcaagcgagcacctatgccagccctgcctctggatggggacttgagagggtgatggaagcctgcagcactggagggaggcagacaaagacaggcctgtgctgagggggcccggagcaagagagagggaggcaatgacagcagagacatgcctgcgccttgggtttgagtgcccagtggtcaaatccacttccctgtggctgatgcttgcctttctaactttggaatttaggggttggagatctggtgagaaggtaggagggagatgaggaggagaagggaaaggcaggaaggaaggggagggaaaggaaaagcaaaaggggaggaggaaggtttccaacaaattattctatatcaactgcggaaatcaaaatttgttgcccaaatcttagaagctcatgtccctcctccccagaagtctggaatgcagcactccaggggtagcttataacccaaatatctatctgtaaaaagagaaacattgggctttcgagctgtggattctcagtaaaagcaagaggcctcagcctacacaggccagcccagagtttgaggaaccccaggcccacacccacagggctggcccctgggtctgcatactccctagaaatgtgcacacttctgagcctcaactctgtcctggagtctaacagcatccctctccttcctggggcagttccacctccagaaacctgttaccttgggccttatgtcaaggaaactgtgggaaagagctaggcaggaatgcagatgaggccagcatgggctcctaaaagtttagaaataggcagtgtcatgctcccaggtgcctgcataaaccagctgaaaaatggagctcccctcaccagcactctcccttcaaacagactgtgatttgcaggtcactggtttaccaagccaggctacccaggcaggacccagatgccaagcccagtggtgtcctgcaagctgagcagtgctcagttcttgcaaaaaaaggtctgtgtgaaggcaaggcctctgcctggcttctcaccccagttgggtgtctggaacaggaaggagcccttactgcagaaaaaggaggagggagcaaagggagcgaacagctgcgtgctccatggggaggatccccaaagtagaaaggcgcatacacactgcagcccttgacccagaatgctcacagctacattacagattcaggtctcctcagtgtagtggggctgctgatgagactgtggcatcctcaggggtcaggacacacattttccatcactcttctgatggcaaaaaacctctgagccaatgccaacctctgatcattaaaaaaaagtgctcacagcagtgtgtggtttaggatcatgccctgtgtggtttggaacacgtgcacaaccacaccttgttcatcaccatcccagaaaccctgacgcaggcaaagagcagagttattaaccctactttactgatgtggatactgaggcccagaggctcatgcaagttatcaataagtggcagggacagttgcctctagattaactagcccctaggatcacctgggtcttggaaggggacccataaacatgagctcccctctcttggggccagatttgcacctgtgccgcgccttcagcctgcatgaagcaggggctgctggcaaagactcaaagctgtaaatctgggttttctcttgaggcttctaagggagctgtttcgacaactcactctgttcccagctggctgcccctgcatagggttttaaagcagcctagctttctgccaggcttggcagtggacaacgctggtcagaacatcccagagagctaccagaatgaagtaagtttgcttctactctttacctgtttatgggctgtctctgccactggaatgaaaggcactgagaacagtgcctggcctgcagaaggccctggaaatacctgagctcctaatctgggaataggagtaggaagagctttggaggcagggcacctgagtttgagatctacaacttcctgcctgtgtgacattgggaaagtctccatcctttctgagcctcagtctccaccctggggaagtggaaatatcaatctctgtgacacagaagcaaatgagcgaatgtgcacaaagtaccttgcacaagagagacgctcaaacacttgcctccaggtttcaccgagaactacagagtaagatagatttgttcccagtggaggaagcctgggaataatttgcccctagactatgaattcctggggctcaagatcgagcacagggccaggcacacagaagggaccctggaaatgtggcaggaggccagagatagacaggcccttagagctcatacccatgccctctgacctcaagaagaaagaaacctgctcaaaatctcacaaagagcttgttccaaccctgaatcgagtctgaggactccttcctgagtccagcactttttctgcaagaagtatatgcctccaaagctgatgggcgcaaatcttgaaccccgtcacataaacacaaagggaggaggtgactagagctcctcctactggatatgtctaaggtcaccagtctaaagaaaagggatggatagaatgaggccagtatttttgcagccatccaaatgtccacatacgctgttacactgagggctcctctctcccccgtcttcagccctacttgcatttagaggtgagaaagatatgggctgaggggttgtttttcatcgtattgtagatggaaagcacactgcccttggggccatccaaatgtggaccttgatgtagcaccccaccttctggatggccatccttctgaaagtcactgaatttctcagactttattctctttatccataaagaaggagaataataataatccccccaccctgcccaaccactgactggttgggaagctcagaagaaatactgggcacggcatcccattgtaatctatagagtgagtcgcttcttaatattaaatggctgaacacagaagatgtgcaaaaagtactgtgtccccttcctcctccaactgaacatttcatgccctttgcaccctcattttgtctaggagctgccttatgaagggaataggtacctgctccgagctggaggaatctttgccacttatggtggggtatggactgagacagagatggcatgtgacatgcgcactgagtctcaactccatgcaggctctggagcactctcaaattggagtactaatgccttttaaattctcacactagcaatcctttgacctactgatctagggatctagggaaagaatcgtgatcttaacttcaaagggaaggacaaaatgttctgcctcctgttaaaactccatacactaagtgcagagactggatgccttattaaccttgggtagatgcccaaatgttcaaaaggtcaaactcttctgttccccagatcgccagagtcattaaccagtcacactattaaatgaatgaacagatgctgaaaaggtacttgcattactgagatttcttatggtgatggcccctgcctgatatgtattcagcattttgtagttttcaatgtgcattagagtatagtggtgatgacattggcctctgagtttgccacttcttatatctgtgactttggtcaaattgcttaatctctctgagtctcggtttcctggagataataatagcttcttcttcccagggttatcatgaggattacaggagataatgccccaaaaatgcttagtaaagtgcctagcacctagtcaatgctgaattaaaggtggttattcttacttttcgttcatttgaactttgttctcagggagggcaaaggatagacaaagccccatagctagtgaggagtagctgcaagactagaacccaggtgttctgagccctagtcttaggccaagaacaactgttacgtgagatgcacgttttccttcaagggagctcacaattatttccatgtaaattcaaggactgctaaaagagaactctcctctgggactgatatcattttatttcaagattgatttgaaacatgttttttgtttgtttgtttgttttctaggaaagaacaagagaaccagtcaagctgaatgcctgaagcaaatctctgttagcgatgttttcaggatgagggagagtggtgcaagaaacgtgcttccagatgcacatggtttcctgggactagggttcagggtgtcatccctgggtgttattaagtgtcagaaggagagcaaacaagggaaacatctgagatccagctaaggctacaccctggaaatgcaagcccagctcttgcaaaggacctcctttggccactcaccttccaggccttacaataacttgtttggactgcaggtttcttggtggactcacaggccattctgcttttatttggtcaacctcagttcacaagcacccagatgctgagatcctcagcatgtgcagcagagtttcatattagcactgggtacctttctgaggctacagggataccgtacagcagcacctgtcacgtccagccaaaggagtgggctctctcaatgtcatccaatgctgtttcaactgtgaagaagaccatctgagagagttgcttttggaggctgaggcaaatttttaaaattctttgttctcctcaactggggtgaattcttggtcttctaggacagcttgaagttttagaaagagtcaagccactcagaaccaacagagaactctttcagagaacaaggtgtggcatagaggaggcagagggctgatcttgatcaaatccaaagtgtgactctaaagcaatgaatgtgaatttttggcaaagcttacaaagggctctaaaggccatctgcaaagagaagccaagcctggaaatgacgtaagcaatgacaacttttccagagtaaatgcacagatggccactccaaggacctattctaaggacaacccccactggaatctgtgcattcaactgtacactgatcaaaaccaaagcagttacttactggccacactttttaagagtgttgatggagttggggagaaggggaagaggacccctgcatccacaatccatcaacactttcttctacaatttggcccaagtgaatggaaacaagtgggaaataaaagagaaatttaaagtcatgctaaaactgatcacggactctgggagcattatcaggtttttctttactgactcaattgttgatcataaaagagaagcatgaaatataaagggtaattaggatggaggttagagatttctttctagaagaggcctaaggcctggcaatttggacaggctgctggccaagtaatgtctccatctctgccatcccacctgactgcaatctctgtgagagctggggagtgcagtaaacagttttgtaaatgtctacatgctcaacttgatagcacattctcaatacattgttggtggttgacaatgaggaaacaaagagaaaacaagatttcaatcacctccatccacatctgtgcacatatcagaattttaaaataaattgaaagctgacttgctgaaagtggattgccctgggaattggagaagacaggccctctagttatgtgaaatggcattacctcagagcccagggcttccagttctatgaaaaggaaggaagccgacccacggctctataagagccatttcctctctgctctattaattccagagattaagcaagccactcctctgtggccctaataccctgagataacagctattgtgtttgctgcaattcctgctaacagagctaatcttggtagattggtggtgttgcaggcttttattgtcaaattaaactagtcaatggctctcatagtcccttctatcatcatcctgctcctagaactaccactggaatccctaatcctgaggttcagaacacttggatgatgtctgagttcccagggaggaaagtagaagtgtgtcagatgagtttctaaaaggacaacagggccagaaagttgaatgggaagacctctctgtgcctactcactagctttttgttctcagtcatactaggaagctcatgcaatatatctagtgcttgccattctgactggcttctattaagagaaaaagtaaactcgtcttccctctctcatccttcctcatttttcttattgaatgggtgcaatgcagtgatcactactagactgggaggctatatggaaccttagactatatttccagctcttctagaaacccacaaggggtgggatcagctcatctcctagatctcttctagatcacatttgaattccttatattttgagttggatccctgccaccaagtttgcacagaaaatttcaataacacatcttacgttcaagtttaagattagaagcattaaatacccccctccccccatggcccattgtctgaccgattcctggagctttctgggctcctgacgatttcccaccatggcgaaatggggaagcatgctcttgattacaagccgacttttccagtcatccattgtttgacctgcaaatttattcttgactctccaaggcgtttcccaaacgacctagacacagggcttagggagacaaaaagtacactgtctttcagatatgaagatgagaccactgaccccgtgaatcacagactttcactctgaagacaggtttgtgtggagtcaaccacattccttttcccttcctcccacccaccaccctcattgagcacccccacccccaagaatgaggggcatttttgtgagacagttggctgggataaaatgacagtccttgaccagaggaaaggacaaagttcactggaaggtagaggggtggatggaggagcagcttcatgtgactaaaataacactgggcctacaagtatgatatctgggtcctacgtctggatttgcttttgtgtgatatgcagtgagattcaggaaaacttcctctgttctctgagatgcaatttccttatatgcaaacatggtggctcaattaggtgatggcttagggccttctcagctctactagagtaagctttatggttcatagaagaagcagacacccactgtggcactgttaggatacagccaagtgagctaacagttcaaagcctgacagacacaggaagggagcaacagatattgaaagggggctcatgaaaccctggtgcactgatgtaaaggaaactgactgagcaggttatgatcatggctactcctccagtgacagataagcagacatatgcaaacccaggtaaagtttcatttctttttgtttttcatgatgtagacatgaaataagagctccactaagacattaatatataaggacagctctacttcccataaacctccttggcagtacagcatcagcctctaaaatctcaagtctaaacctctgcctctggaaatatggagaagtacttttccccattctctcactgagtatcactaaaacctctgggcattatatataaaacaaacataataagacattaaaaggtggaaagaaaaaagtatactggttagggaccttgggacctgagcaatgatgcagtggcgagttctctggattttgtttctgcctcatatataccagacttggagctgaagaagccagaaacccagaatgccaatgggcactaacaaagaagccccaacaaaagcctgctctttctagccaaaagaccaggaaagaggtaacctagcaagacagaaaacttttagacaataactgctctactccagccaaacaccatagaagaaaatgcagtcccattatattccatcaacaaaagccaaatgaggagcctagactccacccccacatagcagtaatgaggtgcccttccctatccgcactagagtagtatcagtaaaagcctagtagggagttggaatcctcacccctgtccagcagtaatgaggagctccatcctccctgatgtcaatgaagaataagatggtgcccgccttccctgccagagcagtgtcagaggaagtcagctaaaacagaaaatttaaataagatccagtcttataatgcaatatccaaaatgcccaagtttcagtagcaaagcacttgtcagaccaagaaccagtaagatatcaaatggaatggaaaatattatcggcagatgccaacagcaagatgacacagatgtcagaactgcctgacaaggattttaaagaagtaatcattaaagtgcttcaaccaacaattacaaccatgcttggaagcaaatgaaaaaaatatagaaagtctcagcaaagtaatcagaattctcagcagagaaacagaacatataaaaaagaaccaaatggaaattttagaaatgaaaaatacaataatggaaataaattcagtgaatcaaatcaagaggataatggtaagaacagaggaaagaattaagatagaacaatagaaacatcacactctggggactgttgtggggtggggggaggggggagggaggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaaataaaaagaaatgatcaatctgaacaacagagagaagatatcctggaaaaaaaagtaaacatagactcagggacatacagaattacaaacaaaagatctaactttcatgtcactggaattccagaaggagatgagaaagagaatgagaccaaaaaaaaaaaaaaaaaagtattcaaagacataattgctgaaaactccccaaatttgacaaaagacatacatctggaaatttaagaagctgagtgaacctcaaacagtataaatataaagaaatccactccaagacctgtaacaacaaaacttctgaaacatgaagagaaaagccttgaatacagtgaaagagaaatgatacctatagaagaaaaataacttgaatgagagtgaatttttgttcataaaccatggattccagaaggaagtagcataatatttttcaaatgctgaataaagagaactgtcaacccagaaccctatactcagtgaaaatatgcttcagatatgaaagggagatcaagacattctcagatcaagagacactaacaaaattagtcaacaatatgcctctacaaagagaatatctaaagaaaattctctaagcagaaaggaaatgataaaagaaaggatattgaacattagaagggaataaagaccaatggaaagagaaaaaattatgggtaaatataatggactttccttctcctcttgagttttccaaattatgtttgaaggttaaatcatcgattataacattgtctgatgtgtctgtaaatgtatgtggaaggaatatttaacacaattacattataaatagaggaaagtaaaggggtgaaaggagaggtagggtttctatacttcactgaaactggcaaaatgttgacaccagtagattattatgttatgcatatatataatgtaatacctagagtgatccctaaaaatgctatacaaaaagatagattcaaaaatgctatacatgaaccaaatggaattctaaacattgtttgagtaacccacaggaagtcagaaaaaagaaaatagaaaaacaaaaaaccagagaacaaacagaaaacaaaaataaattggcagaactaagcactaatttatcaataaatacaataaatgaaaatggtctaaacataccaattaaaagacagagattggcaaagaagataacatgatccaatgatatgctgttgcaagatgctcacctcagatataatgatttagaaaggctgaaagtaaaataatggaaaaagatacaccatgcaaatattaattttaaaaagtaacagaggtggctctagtgatattagataaagtagacttcagagcaaaaaaaaaaaaaaataccagcgacagatagggacattacataatgctgaaagtgtcaatccaccaacaagacatagtacttttaaatgtgtatgctttaaacagaagacctgcaaatataggaagcaaacgtttttagaactgaacggagaaatagaaaaattcacctttatagatggggacttcaacaccctctctcaacaactgatagaacaactacacagaaaatcagcaagatgtataagagcccaacaacaggtttcaataaggcctaaataaaatgtatagattgctccacctgaaaagaatataatttacattacttcaaacacccaagaaatatataccaatatagacatatttttggtgataaaacaatccacaaaatattaaaagaattcaaataataaatgatgttttctctatgatggaatcaaattggaaaacaataacagagagacaacttgaaaatctacaaacacttagaaattaaaaagcatactttgaaacaaattcatgggttaacgaggtcttaaaagaaataaaaattacattgaactgaattaaagtgaaaatacaatgtatcaaaatttgtgggacacaggtaaagctgtgctgagatgataatgtataaaactaaatttttgtgttagaaatgagggaaaatctaaaattaataatataagcttccacttaaggaacctacaagaataagaataaaataaacccaaagcaagcagaaggaagaaaataataataaaaatcaataatactgaagacagtttgatagcagagtatatggtgaccatagctaacaacaatgtattgtatatttctaaatagctaggagagaggacttgcaatgttcccaacacatagaaatgataaatattagcgataatggacaccccaagtaccctaacttgatactttcacagtctatgcatttaacaaaatatcatatgtaccgcatgaagatgtacaaatatttgtatcaataaacgtaatattaataatatttttattattattaattattaaattattaaatattaatatttatattaaatattatattatattattttatatttaataatttttattaaattattttaataataaataataatattatatttaataaataatattttaaatttaataaatattatattaaatattaaatattattaattattaaataaataataatttaatattaataataatattaaagagagaaaaacaatagagaaacccaatacaaatctagttctttcataaaattaataaaatgtaccaatctctagcaagactgacaaaggaaaaagggaagatgcaaattaccaatactctgattgaaaagggagatgttactatagactgcagacatgaaaaggataataagggactactactatgaatacacatataaatttggaaacttagataaaatggaccaatcattataaaagcacaaactgccaaaatttacccaatatgaaataatctgaatggctatataattatgaaagaaatcaaattcataatttaaaaatctgaaatgaaaactttaagcccagatgacctcactaaagaattatattagttgtttaaagaagaattagcaccaattctacataatatcctacagaaaagagaagaggaaacacctcccaactcattgtattaccttgacagcaaagacaaacactgtacaagcaagaaaaaaaaaaaaccctgcagaccaatatttcccatgaatatagacacaaaaatccttaagaaagtttcagcaatttataaaaaagttttatataccatgatcaagttgagtttattcttggtgtgcaagggtagttcaatatgcaaaagtcaatccatgttaatcatacataccaccatattaccataatatgctatgttaacaggcaaagactaaaaatcatgtgatcacctcaaaacattattgaaaaacaagaagactcacgtcctgattttaagacttaccacaaagcaatagtaatcaaaacaatgtagcactggtataagtatagacatatagaccaatgaaataggcttgagaattcagaaataaatccattttttttttttaagacagagtcttgctctgtctcccaggctggagagcagtggttcgatctaggctcactgcaacctccacctcccaggtcaagcgattctcctgcctcagcttcctggggagctgggattacaggcacccaggtagctgagactacaccatgcccggctaatttttgtatttttggtagagacggtgttttgccacattggccaggttggtctggaactcctgacctcaagtgattcgctagcctcagcctcccaaagtgctgggattacaggcgtgagccaccatgcctggcccctaaacccattaatctatggccaattgattttcaaccagggtgccaacaccactcaatgaggcaaagattagtcttcaacaaatggtagtgtgacaactggatatccacagagaaaagaatgaagttggactcctaccttatatcatatacaaaattcagctcaaaactgatcaacaacctaaacataggagttaaaactgtaaaactcttaaaagaaaacatagaagtaaatcttcatgaccttgaatttcgcaatggaactttatgaccctaagaacatgaacaacaacaacaaaatagataaattggacttcataaaaacttttgggcatcaaaggacgttatcaagaaaatgaaaagacctacggaatgggagaaaacatttgcaaatcatatggctaattaaaacctagtctctagaatatacacataacacctaaaatgcaacaataaaaaagacaacacaataaaaaacaggcaaaggacttaaatagatttattcccaaagaagatatataaatggccaacaagcatatgtaatgatgttcaacattattagtcatcagaaaaatgacaaccgaaaccacagcataccacttcccacccactagaatggctataattaaaaaagaagaaaataacaagtgttggtgagaaggtgaagaaattggaaccctcatacattgctggtgggaatttaaaatgttgcacctgctatcaaaaacagtttggcggtctctcaaaaagttaaacatagaattaccatttgaccccacaattccactcctcggtatatacccaaaggaattgaaaataaggactcaaacaaatacttttgcacaaatgttcttagcagcaccaaaagtggaaacataccgaatgtacatcaattaataaacagataaacaaaattttggtatatccacacagtggaatattattcagccataaagggaacgaagtactgataacatgctgaaacatgaatgaaccttgaaaacattaagctaactgaaagaagccaatcataataggttacatactgtatgattccatcttcataaaatgtctggaataggtaaatccatagagacagaaagcagattggtggttgccacgaactgaggggaggggaagaatgaggactaactgccgaatgagtatgaggttttattttatggtgatgcaaatgtttagaaattagatagaggtgatggttgcataacattgtgaatgtactaaatatcacagattgttatgtgaatttcatctttgtaaaaatatagtgacaacaccaaatgctggtaagaatgtggagaaactgaatcactcataacattgctggtgggaatgtaaaatggtattgccacattggaaaacagtttggcagtttccttaaaaactaaatatccagcaactatatgacccagtaattgcactcctgggcatttatcccagaggaataaagacttgtgttgacacaaaacttgcacataagtgtttgtggtagcactattcataatagtaaaaaactggaaacaactcagtaatgcttcaatgatggtacatgtatactatggaagactactcagcgatacaaagaaatacacagttgatacaagcaacggcctggatgaatctgtagagaatgattgtaagtgaaaaaaaaaagaccatccccaaaggttccatactatattattctatttatgtaacattcttaaaataacaaaactatagaaatggagaactgattagtggtttccagagattaaggagagagtgggtatggaagggaagtagatatgtctatatgtgagcaaaatgagagctacccatggtgattgaaatgttctgtattttgactgtgtcaatgtcaatatcccatttgtgatattgtatgatcatttcaccagatgttatcattaggggaatatggctgaagagtacatagcatctatctgtattagttcttacaacttcatttgaatctacatcatctcaaaaaaataattaaaatcatagtatcctattatgtgatgcagaaaaagccttcaacaaaattcaacactcattcatgataaaaaccaggcacagaggggaatgtccttaacttgataaagaatatttacagtaaatctacagttaacatcacacttcatggttaaagactgactgctttccttctaagagtggcaacaaggcaaggctatctgctcttgacactgatattcaacataataccggaagctctagctagtccaataaggcaagaaaatgaaataaaatgcacacattttaaaaaagaagaagtagctgcctccatgccacattgccatcgctgacactgtgaacatctgcatggaggctggcaacccctgcacctaccggcacccaccccaaccaaagaaagtgcaccctgccgttctgctactgctgctggcacatgtgaatgagcatggatcctgctgctactgtccgatggagtgctttggctggcaccatccattgcagtgttgtgaccagcagtccaggaacacctcagccccttcagcacagcaggtttctaaccttgaagggccagagaacaaaactgaggacttgataccagcccctcagagttagaacacacagcccagaagtcctgagctgagctttgccccactaaaatctcccagaaacaaaaccagccaactgaactcaccttatatcacaatcaaacccccaaggacatcaaaaaagaaaaaaaaaacatgcaaaggaatgcaacttcaaagactgaaagaatttcagcccacaaagatgagaaagaaccaggccaagaactctggcaactcaaaaagccagagtgtcttgttacctccaagtgaccacactacttccccataatggttctttaccaggctgaaatggctgaaatggctgaaatgacagaaatagaattcagaatatggatagaaatgatgatcatcaagattcaggaaaaagtcaaaactcaatccaaggattctgaggaatacaataaaacaatacaggaaatgagagacgaaatggccatcttaagcaagagccaaactgatctgagagagttgaaaaactcacttaatgaatttcaggatacaactgaatgtattaacagcaggactgaccaagctcaggaaagaatctcagagcttgaagactggctctttgaaataactcagacaaaaataaagaggaagcaataaagaagaatgaccaatacctctgagaaatataggattatacaaaaagatcacatctatgactcattggcatccctgaaagagaaggagagaaagcaaacaatttggaaaacatatttcaggatattgtccacaagaatttccccaacctacctagacaggccagcattcaaattcaggaaatacagagaacccctgaaaatactacacaagaagaccatccccaagatgcacagtcatcacattctccaagatcgaaatgaaaaaaaaaaaaatcatgttaaaggcagataaagaaaaggggcaggtcacctacaaaggaaaccccatcaggctaacagcagaccattcggcagaaaccctacatgctagaaaagattgggggcctatattcggcattcttaaagaaaataatttacaaccaataattttatttatagccaaactaagcttcataagtgaaggagaaataagatccttttcagactagcaaatgtgaagggaattcattaacagcagacttgccttacaagagatcctgaagggagtgctaaatatggaaaggaaaggttgttaccacccattacaaaagcactcttaagtacatagaccagtgacactataaagcaaccacacaaaaaatcctgtataataaccagtaaacaacatgatgacaggatcaaatgcacacatatcaatactagccttgaatgtaaataggctacatgccccaattgaaaggcacagagtgccaagttgagtaaagaagtgagacccaatggtatgctgtcttcatgagacccatatcacatgcaacgacacccataggctcaaagtaaagtgatagagaaaaatctaccaagcaaacaaaaaacacaaaaaagcaggggttgctattcttttattttttttgagacagagtctcgctctgttgcccaggctggagtgaagtggcacaacctcaactcattgcaacctccacctcccaggttcaagcaattctttgcctcagcctcccgagtagctgggattacaggtgcctgccaccatgcccagctaattttttgtatttttagtagagatggggtttcaccatcttggctaggctggtcttgaactcctgacctcatgatccacccgccttggcctcccaaagtgctgggattacagatgtgagccaccgtgcctggccaggggttgctattcttatttcagacaaaacagactttaaaccaacaaagataagaaaagacaagaagagcattatataatggtaaaggcctcaattcaacaagaagacctaactatcctaaatacatatgcacccaacacaggagcatcagattcataaagcaagttcttagggacctccaaagagacttagataaccacacaataatagtgggagacttcaactctccacaggcagtattagacagatcatcgaggcagaaaactaacaaagatatttaggacctgaactcagaacttgaccaaatggacctaacagatatccacagaactctccaccccaaaacaacataatatacattcctctcatctgcaaatggcacatactctaaaatccaccacacaatcagacataaaacaatcctcagcacattcaaaaaaactgaaatcatgccaaccatattcctggatcacagtgcaataaaaaaagaaatcaatgctaaaaatttctcaaaatcatatgattacatggaaattaaacaacgtcctcctgaatgacttctgagtaaataatgaaattaagggagaaatcaacaaattatttgaaactaaggagaacaaagatacaacataccagaatccctgggacacagctaaaccagtgttaagagggaatttcatagcactaagtgtccacatcaaaaagttagaaagatcttaaattaacaacctaacatcgccactacaggagatgtagagtaactagagaaacaagagcaaatgagccccaaaactagcagaagacaagaaatagccaaaatcaaagctgaattgagggaaaagatgtgaaaaacatacaaaagattgaaaaatccagaagttggttatttcagagaattaataagacagatagaccactagatagattaataaagaaaaaaagagagaggatccaaataaatataataaaaaatgacaaaaggcatgttatcactgacccaacagaaatacaaaaaatcccctgagactacaccaacacctctatgcacaaaagctagtaaacctagaagaaatggataaattgctgataacatacaacctcccaagattgaaccaggaagaaattgaatccctgaacagaccaataatgagttctgaaatacaatcagtaataaaaatcctaccaaccagaaaaaagcccaggaccagatggattcacagtcaaattccaccagatgtgtaattcctggtaccactccttctgaaatcatttcaaaaaactgcggaggaaagaatcctctataactcattctgtgaggccaacatcatcctgataccaaaacctggcagagacacaacaaaaaagaaaacttacggccaatattcttgatgaatatagatacaaaaatcttcaacaaaatactagcaaactgaatccggcagcacatcaaaaagctaattcatcatgatcaagtaggctttatccttgtgatgcaaggtcggttcaacatatgcaaatcaataaatgtgattcatcccataaacagaactaaaaacaaaacccacatgatcatctcaatagatataaaaaggctttcaataaaattcaatatcctttcatgttaaaaaatctcaacaaactaggcattgaagggacatacttcaaaataataagagccatctatgataagcctacagccaacatcatactaaatgggcagaagctggaagtattccccttgaaaactgggacaagacaaagatgctctctctcaccacttctattcaacatagtattggaagtcctatcaggagcaatcaggcaagagaaatacataaagggcatccaaatagggaaagaggaaaccaaattatccatttgcagacgatattattctattcctagaaaatgccatattcttgcctaaaagttacctgatctgataaacaacttcagcaaagtttcggaatataaaatcaatgttcaaaaatcagtagcattcctatacaccaacaacatccaagctgagagccaattaaggatgtaatcccattcacaatagctacaaaaagagaaaaattcctgggaatatggctaaccaaggaggtgaaagatctctagaacaagagctaaaaaaaactgctcaaataaatcagaaatgacacaaacaaatggaaaaacattccatgctgatggatagaaagaatcaatattgttaaaatggccatactgcctgaaacaatctacagattcaatattattcctatcaaactaacaatgacattcttcagagaattagaaaaaaaaataaaattcatatggaacctaaaagaaactgaaatagtcaaggcaatcctaaggaaaaagagcaaagctggaggcatcatgttaccaaacttcaaactgtactacaatgctacagtacccaaaacagcatgatgctggtacaataacaggcacatagaccagtgaaacataatagagagcccggaaataatgttgcacacttacaaccatctgatcttcaacaaagttgacaacaagtaatgaagaaagaactccatattcagtacatggtgctgggataagtggctagccatatgcagaagattgaaacttgaccccttccttacaccatatagaaaaatcaactccaggaggtttaaagacttaaatgtaatacttcaaactataaaaatcctggaagataacttaggaaatatcattctgcatataggctctggcaaagattttatgacaaagatgccaaaagcaattgcaaaaaaacccaaaaattgacaaataagacctatttaaactaaggaacttctgcacagcaaaagaaactatcaacagtgtgaacagataacctacgaaatgggacaaaatattctcaaactatgcatccaacaaaggtctaatatctagaatctataaggaacttaaatcaacaagcaaaaataaccccattaaaaagtggcagagcacacgaatagatactttttaaaagaagtcatacatgtggcaaacaagcatatgagaaaatgctcaacatcactaatcattagagaaatgcaaatcaatatcacaatgagataccatctcaccccagacatttaatggctattactaaaacataaaaaaaaaacagaggttgtggagaaaggggatagttatacactactagtgggaatatataactaactgaactaatagacatctacagaacaaaaacagtttagtgatttctcaaagaactcaaagcagaattaacacttgacccagccatcccattatcatgtatatacccaagggaatataaatcattctaccataaagacacacacacgcatgtgttcatcacagcactattcacaatagcatatacatggaatcaacctaaatgcccatcaaaagtagactggataaagaaaatgttgtatatatacactgtgaaataccatgcagctgtaaaaaaaaaaaaggagatcatgtcctttggccctttgcataaatgtggatggagctggtggacattatcctaagtgaaaagaacaaaagtccacaaactgcatgttctcacttacaagtcagaggtaaacatcgagtacatatggacataaagaggggaacgacagacactgaggcctacttgagggtggacggagggaagagggtgagaatcaaaaaactacctatcaggtactatgcttattacgtgggtggcaaaataacctgtacaccagacccctgtgacatgcaatttacctatatatcaaacccgcacatgtaccccttgacctaatttttttttaaaaagtagaaaaaaaaaacaaggaagaagaagaagtaaaacgattgcagttgacatgattgtctatctgaaaaatctcaaagtatctacagagaaactgctagaactcatacatgagttcagcaaattctcaggatacaagatcaacatataaaaattaattgcattcctgtatactagcaatgaacacacagacatcggaatgaaaacacaataccatatactattgctcaaaaaacacttacgtgtaaatcaaggaaaacatgtacaggacgtataaactgaaaattacacaacactgatgaaagaaatcaaagaattaaagaaatggagtaatataccatgttcatagattggaaaactcaacatagtaaagacattgacttctcccaaatagacatccaggtttaaccaattcttatcaaaattcaagtaagattttttgtagatataaaaaagatttttccaaaattttatggaaaggaagtagaggggctgaaacaattgtgaaaaagaagaataaccagtgtacctgatttaaagacttattatagggctacattaatcaagactgtgcagtaatggcagagggacagacagataattggaactggacagagaacctagaaatagactcacgtagatacgccaaactgatttttgacaaaagtgcaaaagcaattcagtggaggaataatagccttttcaacacatggttctggaatatctataggcaaaacatgaacttcaatctataccttataccttacacaaaaattcactcaaagtgatcactgagctaaatttaaaatataaaactataaaagttttaggaaaaataggagaaaatcttctggatttagagctaggcaaagagttctttcttagacgtgacaccaaaagcataacccataaaaggaaaaattcataaactagacttcatcaaaaataaaatctttcgctctgtgaaagaccctgtgaaagaccctgtgaatagaatgaaaagtcaagctgtagactgggagaaaatatttgcaaaccttatgtttaacaaaggacttgtatctagagtgtataaagaatatcaaaacttaacagtaagaagacaaaccatccaattagaaaacgggcagaagccattttgggggccaaggtgagtggatcacctgaggtcaggagttcaagaccagcctggccaacatggcgaaaccccatttctattaaaaatacaaaaattagccgggtgtggtggtgtgcacctgtaattccagctactcatgaggcaggagaatcgcttgaacccatgaggtggaggttgcagtgagccaagatcacaccactgcactccagcctgggcaaaggagtgagactgtcaaaaaaaaaaaaaaaaaaaaaaaaagaaaagaaagaaagaaaagaaaatgggcaaaagatatgaagaggcatttcactgaatttcactgaagaggatatacagatggcaagtaaacacatgcaaagacgttcaacatcattagctattagggaaatgcaatttaaaaccacaatgagataccactacctacttaacagagtggctaagctaaaaaacaatgacaacatcaaatgctggtgaggaagtggagaaactggatcactcatttactgctggtggaaatcagtttgacagtgtcttacacaactcaacatgcaacttccatatgactcagcaactgtactcctgggcatttatcccagagacatgaaagtttatatcaaaaatttatatataaaaatttatattttagaatagaaaatggttcttataaatttttaaaatttttatacggaaacctgtagcaatatcaatttccaagttttgatattgcactattgttatatgagttgtaaccactggggaaaactagatgtaaggtacaggggggcctctttactgtgtttgcaacttcctgtgaatctaatttttcccaagtaagaaactaactgctattccaaaaggacttcagggtccagatgcagggggacatcaattcttcttactgcttttgggacctttcctacatagcactatttttttcaatcaacttttgatgtttgtacagactttcttatttaaaaaaaaaccaattcccacccaaatatttcttgggtgcttcaggggccaagcctgaggcctcaggagtgacctcatacaaatgtgagggtctagagacatcccagtaaagataaaatggcatgatatacaatgcacccaaatgaagaagaaaaaaaagaggcctctgatactgctgaggccatcactaactccctcatccagataggcccagcatctccagcttctctggaggatggaagctcagatctcattataggactggcaacacaaaacctatcaacttcaagcaagctgcccattcagccctaaagaaaaaaggtttaaaatgctgctttggctttcaaagactccactctattgattttatgccttccccctttgtgacacccagagccaatgtaaaggggactggtgaggtagtggccaaaacttcctacacaaaggctcaattctctggtgtgcagtagctgcctactccctcaccaccacaatcttcatcaggtactggctggacccaggaagcagggccaatggaagggacactggagagggatcactgcctgtacattgactttggtccaagttgaaaggtatctcacaacctcagcacattagcctgtggacacagctttgtttcttctttccctctacatgaatccaagcctatgaaatagcccttaagcagacctttctgtccaaagcaggagtaagccaccttttgcatccaaatgcctggctgtgtaccatcttcccatggcaatgttcatgagcacctgcccaggaagcctatgcctctgatagaaagaaaccaaatcctcagcaatgtttctcactcatgaacaatccagggataaagaggaactccaaagccatctgccacatgcaatttggagtttagtcaaataaatctgtgggtcttcaactttcgattttatattacatccatgtttgctttaatataggaaaaaatgcctgcgtcctcaagtaaatggttgttccagggacatgtgttgctctatggctttgttacttgtggacccaggaagtggagtggagtgagtactgtactcacaccttagtcacagaaacagaggcctgtgggcagtctcttttcccacatcaggctctaagtacacacctgggagcccttagccacccatacccagaagaagatatgaaagagagcaaagaccctctgtgctgggctctgaaggcaccccagtaaccccagagttatcactggtttacccctccttacattatctacgacctcttgcttatctgggacctttagctcccagaccatggaccctgctggatccctaatgcccatctcaaagtgccagttggagctagatctaccttgctgccacctgactctaggcatgacaggaagtaaatgaggaaccaaatcaaaggcacctggcaagaaaggaagaggagtatgtggatattgattgagcaaccccaaaaggctgaaatctttagaagctcaaaggtgtctgagtcccacaaccctcaccaaatcagaggaaaaatgaactaaggggcagaaacaactttgggcttcagcctggaacgtccaaaggtgagctgcattgtgaagtcaagctctgtgcctgtttctgagctgtactcttagtgactccaggtaagttgctggacatgcctgagtctgtccctcatcctaatagcttcttcctctgttgcctggatagggtgaggtgtggttcaggcattcccaagaaaagttctgaggtgaggccatcatgtcctacctggagtctccagactattgggcagatttggggttaaggcagaagacattgaatattagagccatcatttttcaagggtgaaatttggccctcaaagaaaagaaaagccaaaagaactcctgctttcaaatgagcttgcagaagaatggaacacatctacttgggtgaagataatgttgatggcagagtaattcaagtctatcttcaaacatgcatgttgatgttatggattgaattatgtcctccaaattaatatgttgtcattctaactcccagtacttcataatgtgatcttatttggaaatagggccattgcagatataatgaggtaagatgaagtcttactggagtagggtgggcccttaatccaatatgattggtgtctgtataaaaaggggaaatttggacacagaaacatgcacacagagagaacactatgtaaagattggagctctgctgcctcaagccaaggaaagaggcctagaacaggtctttccctagagctgtcagaggaagtgtggccctgctgacacaccttgatcttggacttctgcctccagaactgtgagacaatcaattctgatgcttaagtcatctagttttaatattttgttatgacagccctagcaaactaatacattggggataaaaatgtttctgcaggcaaggtgaagatgccagtggagactggcccatttccacagcagaccatacttgctggttactttgagcttctgggcctgcttagtcttctgtggtgagggactgatcatctctcattatgatgaataagagctggaacatcctgagatcctgagcccagagcagtccttggctcttggcatttagaggacacctagctctggattcttattattctgctatccctatgagcctgaaaccagggatcatttatctcaggtggctctcaaccagaaaacccaacaaaatactttgctcatggcaaatgcttataaacttctgtagacaaaactgtggtacaggggccatatgggaatggagaagaagcaatcggaaggcagcatcttcatggaaattttgcatggcttgatggccagctgaatacagaccaggaggctaaggccattcctactttccagacttccggcctggatgttgggaagaaatgtggggctgctgataggcagagaatgctgcaccagcaatagactcctcaagccactgtcatcagtcatgaccacttctggctgcaattagagcagatcaccctgctgtactagggactagctaactgttactagttactgtataccactaacaatcttagtgttatgctaggacatgaataaagtaggatgccttgatccaggaaaccagacctgggagaagcagaagagcccagtctggagacaggcagggcaaggttaataaggctggcctcctagatgtcagtatagccaaggctttggagcccaacaagcaggacctgaaacagaaaggttggcttctcagtcatgagttacagggctctgggaaagctgtttaaactttaggactcagtttcctcataggtaaaatgcaaagttctatacaggaatataacagctatctttgggtgcctgctatgatccagacactgggcttgacaatttacacagagcatttcactggctcgctccaacaaccccacaaggtacataggaagagccttctgtacaggtgctccctctgtgttccccaggtccttggcaggaagtatttgtctagcatttgattcctcctctagactgtaaattcttgtgagagaaggaaacatgtcttttatgtggctgtagccccagagtgttcagagaatagtagggtctcgggaatgatctcccgaatggatctgcagggtggattcaagcttgggtggagggctggactagaactctctgaaggcatcacccaacctagagcctggatgacttggtgtgctggagcacaagtgagcttagcaatgcataacacattgcttaatatttctgtgaattttaaaggactgttttgacactatacaagagctgtgaggcatataattatagccttgtgctaatagatatatcaatattctaaaacatcacttttagctttgaaaagttgactttaaaaagctcaaagtgatgtggagaaattggggccctcatacattgttggtgggaatgtaaaacagtgaagttgttatgaaaaactaacatagagtagctatatgatcctacaattccactcctagatatatgcgcaagaggattgaaaacagagattcgtacaaaatcttgaacaggaatgttcatagaaacactactcatagtagtagcccaaagtagaaacaacccaaatgtctatcatcaggtaagtggataagtaaaatgtggtctagctgtacagtataatattatcatccataaaaaagaatgaagtactgatccatgttataacatggatgaaccgtttaaacatcgtgctaagtgaaagaagccagatacagaaaactacatattgtatgattcaatttatgcgaaatatccagaataggcaagtccatagaggctgaaagtagcttagtggttgcctagggctaggggaaggaagggagaatgtggactgactactaatgggtacagggtttcttttgagggtgatgaaaatgttcttgaattaattgtggtgatggttgcacatctctgtgaaaacactaaaacacattgaattgtaaactttcaatggattaattgaatggtatatgaattatatcttaatgaggctgctttttctagtccaaattgttatcactctttgctctaatttgacattttagaaagatgtttcttttagagaaaagatacaacaaaatcttttaagttttgaaggagaaaaatgtttataccctctaccattagcaagactggttccctttgaaatgggccatcaacacacccttttttccttgtttatatgctgacccagcagtgctggaaactttcttccagcaacccacatatcaatgaacaacttgcaaagttggtgtaggaatattctaagctctggttgatcctacttttgacattgctgctgctgctgctccccaggaactcccaatctctgtccttttgatttcaggaaattttcatgccattgaggttaaaaatgcccccctctcatctgggcgtcatgtgctacccagtgatgaatcagcttgaggccaggacttcctggcaagtacaggtatcccataatcccacagagtgggctcagatggcaggaccctgcttgaaggagccaagaattgtacaaaccaataagccaattgagggcaaactgtctctcaagctgaccatgtgctgaaaacttatttgactctaaaatcaaacagcacacagtgacctcccattatggcagagaacagagttttctggaacttggggacatcaagaaacgaaggcagagcaagactatcttacaccaacaatagcaatgctcatcttgtcacatgattgactgcagaactagccttcaaagtaatgtgagtccaagttttttcaagtccttatttcttgaaaaagaaaagttgaacttgtttagcatcatcttttcctatgctataagcatcatcttttcctatgctataaacatcatacactttgagaattcaaagataccttggatttaaagtggcagtccaaactgaaaattcaagtgatctccgtgctagttttctcatgagctaaatgcctacaggcttaattcccttaagcttttccatagtcgaccaccaaagttggtgtgtgttggagggtgctgttccagtgtccattgcagggacacaacataccactcattagttggtatactctctctctctctctctctctctctttctctctcttctggaaagcactatggcactagaagccctggaggaaaagggccccctctttaagcttggggttatccccatcagtactggtaggcatagattcctctatcttcctctcaaattgctactccggttgttctacagctgactagcaaaggaaacaggggcagcagctggtcttttccttttctgcccttatggactgctcaaccgtagccccaaaggtgcacacacacacacacacacacacacacacacacacacacagagtataatgtttttcccccctggaaatgattttaaaaacaatgtgtccctagacttaccctacaggaacaactggaaatgttgcactaggcaggaggaaaatgttggaaattgtttggttttgtagtaatttcagcaggcagttgcctcagagtgtagaaacagtttgcaaacatgttacacttgggcccaggtgccagtcataccagctggcccaacaaaggcttgcaaagcatttttagctggcggtctaggagaaataatgaaacgaacatggggttgaggaccaggagacctgagttccacttccatccataggtcatttgacctctttgagtctcaggttcctgatctacaaaatggggctgatcctctttactctcctcccctcccatggtgcacataaggatcaaatgagaccttgaaccagaaagccccttggacagggtggtgctgtgtgcactaaaggcacaagggaagggcagcccttttttttcaatgcaggcaatggagacagcaactgagctgaaggacagcaatccctttttgttctcctccttttttatagcaaagcttggttagaatcctagaatgttaatatcaggagggaaaactagagattataaagtccaggctaggcccagtggctcacgtctgtaatcccagcactttgtgaggccgaggtgggtggatcacttgaggtcaggagttcgagaccagcctggccaacatggtgaaatcctatttctactaaaaatacacacacacaaaattaactgggcatggtggtgctcacctctaatcccagctatttgggaggctgaggcaggagaattgcttgaaccccgggaggtggaggttgcagtgagcacagatcacattattgcactccagcttgggagacacagcgagtctctgtcacacacaccaaaaaggtccaatccccttcttgtacagatagggaaactgaggaagagactcacccaggaacatatgctagcaaaagatggtgagagatgactctagaagtcagattccctgaatcccaagccagggcatgagcccagcagaccggacttaaagacagacgctctatgtaatatttccttgggtccacattctgaaagatcctggatagaagcctcataaatctgcaaggcagcctcccaggctgtccagtgaccgcctctccttaaagaagtgccgacatcactgaggtttcaacctctccctggcaagctgacagacgagtagcttcacctctctgagttgcactttctttcaatgtactaaagagcttggccaggaggactctacgaggcttgccagctggcatcatccctgtgttggtgactagctttcctctatggtcatccaccgattacaattccccagccagaggagggtacgaacagacttcccttcagtggctgctggaaagatcttagaccgcctccagattcccagtggggttgggtggagcttggggtcccttctttccacattaaaccaaagactagtgagacatccctcttcccccagatttcaagcaaagcaatctggggaattgaagccctgaatcattaattgggacaatgctcaagattattcagcaaacttagagcccaacacgttctaaaaagaaagtgtcagaaaacaaactcacagctaagaaagagatgtgggcagttgtcactcggcattttgaggggatgtccctataggtttgcatacatgtctagcctctgtctccaattatactggtggtaagtccaacagagaaaactacctaagaaggtgggtagggagagaaagagtgtttaacaagtggccaaaagtagcagtgagttaagagaagaaccagaatagccattaaagaaagaaagaagaaaaatggcaagatggctgaataggaacagctccggtctacagctcccagcgtgagcgacgcagaagacgggtgatttctccatttccatctgaggtaccgggttcatctcactagggagtgccagacagtgggtgcaggtcagtgggtgcgtgcaccgtgcgcgagcgaagcagggcgaggcattgcctcacctgggaagcgcaaggggtcagggagttccctttctgagtcaaagaaaggggtgactgacggcacctggaaaatcgggtcactcccacctgaatactgtgcttttcccacgggcttaaaacacggcgcaccacgagattatatcccgcacctggctcagagggtcctacgcccacggagtctcgctgattgctagcacagcagtcagatcaaactgcaaggcagcagcgaggctgggggaggggcgcccgccattgcccaggcttgattaggtaaacaaagcagccgggaatctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaacgggcagactgcctcctcaagtgggtccctgacccctgacccccgagcagcctaactgggaggcacccccagcaggggcacactgacacctcacatggcagggtactccaacagacctgtagctgagggtcctctctgttagaaggaaaactaacaaacagaaagtacatccacaccaaaaacccatctgtacatcaccatcatcaaagaccaaaagtagataaaacaacaaagatgtggaaaaaacagaacagaaaaactggaaactctaaaaagcagagcacctctcctcctccaaaggaacgcagttcctcaccagcaacggaacaaagctggatggagaatgactttgacgagctgagagaagaaggctttagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattgatgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaactggtaccagccgctgcaaaatcatgccaaaatgtaaagaccatcgagactaggaagaaactgcatcaactaacaagcaaaataaccagctaacatcataatgacaggatcaaattcaaacataacaatattaactttaaatgtaaatggactaaatgctccaataaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggcggttacataatggtaaagggatcaattcaagaagaagagctaactatcctaaatatatatgcacccaatacaggagcacccagattcataaagcaagtcctgagtgacctacaaagagacttagactcccacacattaataatgggagactttaacaccccactgtcaacattagacagatcaacaagacagaaagtcaacaaggatacccaggaattgaactcagctctgcaccaagcggacctaatagacatctacagaactctccaccccaaatcaacagaatatacattcttttcagcaccacaccacacctattccaaaattgaccacatagttggaagtaaagctctcctcagcaaatgtaaaagaacagaaattataacaaactgtctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaacagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaacccttcaaaaaattaatgaatccaggagctggttttctgaaaggatcaacaaaattgatagaccgctagcaagactaataaagaagaaaagagagaagaatcaaatagacgcaataaaaaatgataaaagggatatcaccaccgatcccacagaaatacaaactaccatcagagaatactacaaacacctctatgcaaataaactagaaaatctagaagaaatggataaattcctggacacatacactctcccaagagtaaaccaggaagaagttgaatctctgaatagaccaataacaggagctgaaattgtggcaataatcaatagcctaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattcagatactactcatctgacaaagtgctaatatccagaatctacaatgaactcaaacaaatttacaagaaaaaaacaaacaaccccatcaaaaagtgggcgaaggacatgaacagacacttctcaaaagaagacatttatgcagccaaaaagcacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggagattcctcagggatctagaactggaaataccatttgacccagccatcccattactgggtatatgcccaaaggacaataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaacaatgatgagttcatgtcctttgtagggacatggatgaaactggaaatcatcattctcagtaaactatcgcaagaacaaaaaaccaaacaccgtatgttctcactcataggtgggaattgaacaatgagaacacatggacacaggaaggggaacatcacactctggggactgttgtggggtggggggaggaaggagggatggcattgggagatatacctaatgctagatgacgagttactggtgcagcacaccagcacggcacatgtatacatatgtaactaacctgcacattgtgcacatgtaccctaaaacttaaagtatagtaataaaaaaaaaagtcattgtggtccatacactgaaatatgattcagcccccaaaggaaataaagtactgatccatgctacatcatggaggaatccccaaaacatgatactgagtttaagaacccagacacaagaagtcacatactgtatgattccatttacatggaatgtggcaaatcagtaaatcataagaacaaaaaacaagttagtagttgccagggactgaggtggggtgtgggggatgatgagtgactggtagtgactagagagttttcttttggggtgacataaatgttttggaactagctagaaagtatagttgcacagcagtgtgaatgtactaaatggcactgaattgtaaacattaaaatggccaattttatgttatgtagattttacctcaacaaaaaagtcattgcaggcttgaaatcatatttttgtactcagtttatggaaattgaaggtcaaatttgtggccctaaggagggcagggcagtcttctcactttcagctaagcagtgggcagcacagacagcccaagtgagccaacattaactcccatttgccaacatggaaagatgagcaaggccagtcactgtggctcatgcctgtagtctcagcactttgggaggcagaggcaggaggatcgcttgaaccgaggagtctgaggttgcagtgagttgtgatagtgccactgcactccagcctggggtgacagactgagagaaagaaaggaagaaaggaagaaagaaagaaagagagagagagagagagaaagagaaggaaagaaagaaagaagaaagaaaggaaagaaagaagaaagaaaaagaaagaagaaagaaaaagaaagaaagacagagaaagaaagaaaagaaagaaagaaagaaagaaagaaagaaagaaagaaaggaagaaagaaagaagaaaggaaggaagaaagaagaagggaggaaggaagggaggaaaggaaggaaggaaaggaaggaaggaaaggagggagggaggaaaaggtaggaagggcaaggcagatcagcccttctgagagccaccacaggcagcccacatggcaaaacatttcacaggacatcttacttctgaatggatcaactgcaccctgtaatggaaaaaggtaaaaactgaagggtaaggaggcaaggtccactgtattcattggatctctactaaaggtatcacaaatgattgttattttaaagaacaatttccttcataaacagcttctctctaggctgtggcttcctgagagcccttcagaaagtacaagtgaaaatatattggagattctcacccagaaagctaagaaagcacagggccatcagagcaatgaacaaagcatgttagtacattatatatgaaaacattgcacacattcccattttctgaggctcagggatgtcaccaacaactgcaagatgagctgctggggtgattattctacagctttgttgaggtgtaattgatgtacagtaaactgaaaatatctaaagtacaatttgatcagttttgcatatgtgtacaccatcaccccagtcaagatgatgaatatattcatcagtccccaaagtttccttgtggccctttgtagtccctccctctggcccctctccatcatctgcaggcaaccactgatctgtagtttgcattttctagagttttgtataaatgcaaccatagaatagggaatcctttatgcctggtttctttcattcagcataatgactgagacccattcaggttgttgcatgcatattcatcattcattcctttctacaaattactgaatagtattctattatatgaattataccacaatttatttatctatttacctgttgatgggcatttggattgttttctggtttggggtgactacaaatacagctgctatcaacgtagctatacaggtgtttgtatggacatacactttcattagtctttggcaaatacccagcagtagaatgcttgggttatatggtgtacgtttaacttttaaagaaattcccaaattgtttctttcaaagtagttgtacaatattacattccagcactggtgtaattgtttaaaaatccatggctctctatggagttggcagaggttcatgatttttcacacatgttctgcagcaaattagacattgggctggatccagaaataacctgtgacctgattctggaggctatattattacacatgattgggaggagggtcaagtggtgaagggaaaactggatgtggggaatagggctgcattgggaatagggggccatcaaaaggagtcaaactaggtcctttgaggggaaggctgacagctgcaggtggatgaaggaagggaggggacagccaagtgttcagagcccctgattgcctgcctaaggaattggaactccctgaagaatgaatgggcagtttttctgggcactcacttccagatcctggagcccacctgtgcagccatgttattgcctggatctgggaacccatcgcaatgggacaggatatacttggcctataacttggaataagctagaaagagagggtggttgtgatgttatatgttttccacgctttgagcacttactgttttttacagcccttcttctcttttcttatcatctctttagaggtcagttggagagaggcaaagtggggagtagacgaggcttaatatcagcgaattcctcaccttacagaggccccctgctggacagaggcctttgtgctgggcattctgaggctctggaggtgtgtcagaaggtgcctgaggactgtcaaagtgggggagcaaaaagaatgccagacctggagtcaggagacttccactctaaggtcaccaaccctccccagcgtggccattttcagctcctctgctcctgagagcagactctgaccatccttggatttaaagtgatggggtgagagggtgggatgaggaggaagagaaaggtcttgaacgtttattcagcctaccctcttggccaggcatatgtgctgtgtgtctttcgcatcatgctaagaactatgacaacagttgatctttactgagttctccctctggattgaacatggtgcttaggaccttatagtgtctctttttaaccctcgcagcatctgatgggtagatgctattattgcctccattttacaaaggaggacactaaggcacagaaagggtaaaagcctcacccccatcacatagcaggtaatggaagagctgggaaaaaaaaaagaaaggaaatctttcccagacagatgcaatctaaaagtacaagtcagaaaggaaaggcacactgctccagaccccatcacctcaaagagccttcattgtgaggtagaaatgaccaaaaccaagtaaccccacatcccaagctgcagcttcagcttgttagtctgttgaaatacaggtgtccctgggctcatgatccctgatggtcaagtcaagcagacgtgggtcccatagtccttggaagacccccaccattgatatttttccatcaagatagtaacacacatgttctagaatttctctttggcacacattggctgggtttggggcccttcattttggcctcaaatgaaggcctggagccctaccaagggaaattcaggcagaggcagaagagcagagccaccctggtatgattcagccccaagaggatgagacagtacccctagaagagtggtcgagggtctgactcagcttctcccctgcccctccttcatttgcgctctccacttcattttcatctctgaaagcttcttctcagccatttcccaggaaggactgactcatggctcccaaactctctcagtggggaaaaatggtggagtgcccatcgactattacaggcgacggctgtgtcctctgtccatatgggcccagccattccggaactcaaacataaagctctcaggagaacctctctaactggccataaaaagtttcattatacctgaagaggaagcagagaggctatagattcatggatgccctcgattttctggtgaaacttaatgaccccatctcaggaaaaaaataataataataaataaatgtttttaaaagcataaaataaaacaatgggatcaaaatagttattaacatattaacaaaacaaatttgcgatatattaatttatgtgcttcttaactcattaaataagacctagcagtaggtctcataattactgtaatttcaaggtagtgatatttgaagattcctgctatgactgtaatgtgaaattaaaatatctatgatttctcttggcgacaaagtcacagattatgtaaatactactgtggtttgttgccaacatgcataattgaagaaaggctgaatttcaattagaggttagtgaaaacagaaatataattttttcctcattcaagtttacagactccctgaattctatccttgaatcctaggataagatcacctgctaaagaaacactgaaacctatttgattacttaggctttttttttcctgattcctcagctaagccaaactgttgtccttaccactttttctgatactgtgttttcttcttactgccaaagcacaaccaaggagcttaggttctagtcctagctcacccacttacaagctgtgtgactttgaatgagttgctgaatctgtttgaacatcagttttctcctctgtgaaatggggatactaatagtacctacttcttggtattgattaaatgaaatgcttgtaaaacattctggcactctgttagcacatagaggttagtttagccacaataattaatgttggggaaagagtttataaaccaaaaggtagcatgtgtgtgttgatcattataacaatctgtcttattcttatgtgatttctctctttgctggctctatgatcccagagtggagagcataggaaacatacaggcagaggaggggacagtggtgggctagagttatctcaaacgggctcccaaaagccaactgttatgttttcaggaattttgcaaggtgggtgacatcatgttggtagctagaaatcggccacaacaagagtatttacaacacggcagtcagtgctatcactttaatcagagctttttttttttcctcctagagagccccttgttaaacacttcacagtgcatcactgggagagggtgactggggcgccgctcttatcaaaatgatggtgaggccacctgtactatatctggggaaaatgaaacatcaaatggatttcaggggcaaaaacattaaatattctttgtggtccaagttaatttaatttgctctccatttttttttcatctttttcttgattaatgctctcagttcttgacaattacttccatttcatcaattctacaaaaagagtctgttttgagataagaaaaaaagaatctctgttccctttatctgcagagtgaaatatactttacttaaaatccaacatttctatatattagtaacttgcctccatgtcaacttttatctgtaagagtctactgcatctttcccagagagtgttgcaaaggcacagagcagaaaagtgagtttactgattatgcagccctgttggtgttacttgagtccaaatgttggcttagatggtgttttcagaactcctaagtggatgtttatgtctgcaaatggaagcactgagtagctagattttcagggccaacgcgggggagtcagtcctgagtggtggtttgctcaatcattggcatttggttgcatgagctgttttcaaatgtgcctctgctaccttgacagtcctgtaagccacttgtatatgctgttctccatctgttaagtatgctaacacacaatggagaaaggaaataagatagggagtggcaaaggaaaaaacttaaagctatgaagatgtggaatctggcggagaagaatggctatagagtcgtgggctcccatgagtcctggaagggactagacaacctcttctgcggggctgctatacaggtgctccaacagggaaggcatgtcactaaatttgctctggccttgagttgttccatggagactttgggtggctgttgagctattggcccaatgctatccccacgaggattccatttctcttggattgtgttgggttttatgcaatgtggttacagtcagtgtggtgcttcagagtgtctcaagcttacctttgctgggtagtcagcatcattgtgctccatgcgccagttcatgtctctggcttttccccttgttaagaccccattcaattgaataaggctgcctgtggcaggcaggcctggcaggctgccgtggctggacttgagaaaagtgaggactacaagcctaaagccaagctcgcgattggaggcccgcccatctgatcagttctggtctctcagtgggaagttcaacccctcaccccagataagtattgcatgtctgaaaaaggctttgaagagagatgcaaagggcttaagggtgcactgggacattaatattatgattacctaaagacagtaaggagccagggatgtgaaccattgctgccagaatgggatctggtttctgaaagcaaaggtgataaaattagcatccagccacttgactagtccacactcatcctttcctctgataatggcatggctggtatacttcattcagatagtcactggctcggccggctctccactaaacggggctctcagaagcaaaccaaacagtatccacttgtatgtgtttatgcctgtggcaatttcagattgttcctgtcaaaatgtacctgttttccaaaatgtctttttaaatccaagtttcacatttgtggggaggtgggggaagtaattaacattttataaagtaagctggagaaactggctcctataattgacatagaaatggtatgtggatattgctgtcagaaattgagcaggaccttgaacctgatagtagtgagcccaggcctaggaactgggtgtgttccttgatctcttgtttgttctgggccctgataggaaaggaactccctggaggtcgcagaccttggtcccaccttacattgtttgtcattcagagaggacactgaagctcagaagaagtcaggagctggctcaaggccccacagcaacgaagcagtaaagcctctcaaaagccagcctcttgactcctaggccagctcttaagtctaccccagtagaatgtctggcacctttataggtccctttgttctctgctacccaactgcatttgcattgaagttagtaattttttaaggttggcattctttccagagccatttgccacaagggggaattcttgcactcactcattaatttatcattgtgcacctgccacatgccaggctggcttctacggactggacattcagcatgagtctcctattttggaggggagagacagacagaaaaacaatcagcattgttttctgcaccatgacaatgtttcactccatccagcagctatcatcacagtggccaggtttccctctgctaggactggaatggaggcttggaggaagacagtgccactagctaacatcggtagggcttaccacatgtcaacaactgttctaagcatattacagatgtgcctttgatcctcaccacatccttacaaggcagatgctattattatcatctctcttttacagatgaggaaatagataaacacagagaggttgaatatcttcctgcaaggccacacagctcatcagtggcagagctaagattcaaacacagaccactgggtgccagagttcagcttgaaccacctgactacactgcctgtcaggatggcttagaacaagcttgtccaacccatggccggtgggctgtgtggagcccaggatggctttggatgcggcccaacacaaatttgtaaactttgttaaaacattatgaagttttttttgatttttttagctcatcagttattgttagttttagtgtattttatgtacggcccaggacaattcttcttccactgtggcccagggaagtaaaaaattggacacccctggcttagagtctaaagcctctcctgcattcccagaccccgctaagtccaaggaggcataccagccaggccagggtcctccctactaagggtaagcaccttcactctggaaggaagtcagaggcagccatgtactggctaggtatcgccaggcctgaccagtgctccgttccccttcctcagccaaagtgctttcctctgggataggaaccacagccccatttgcttcacaggatggttgtgaggctccagggagctggctccaattacaccagcccctgtcccccacaagtttgccagcactgatggccccccaccccaactctggattccaagctgggacatcaggtttagcagaggatgatagattgttgccttgcttgatgagttctttgccactgctccctgtgctttggagcagtcttgccagcagcaagtccagttcagcctttggtatgcacaatgcctcttggcctccaaccacctggaaaagctctagctgaggccgctttaatgaacagaggggatatgtacaagtaggaccagaggttgctcagaggctgtctgtcatgtctaggatgctgccaccacatcccacattgccccaatctcaagatttccctaaaaacctgcccagtgagaccctttgctgccaaggacactttctctggctgatttccttgcttccccggtcccagcaagccacctgtcaggagttgtgagccccagaagcagaaactaaacttacttattgacaggaacagcaggcaggctgccagtgaatggaattcacttcatttaactggcctgtttgctgtgcaaatcacatgatttttagtcaaatttagggaataaaaatttaataattaaaaccatatgatcgagaaccatatttttaaaagttaatgatttaaagtgcccccacaaaatgttctaaaactaaaatggtgtttgtgtggggatacagattttcatagaaggaaacataatcaaacacttattaagaagagagaagtccatgtgtcagcatgttgacaatactgggattctattttgtacttttggctacaaacaacaatgtgaaggctctgagactcgtgacttgacatccaaacacatcaaaacaattaggagtgtgagagggaaagatttcagttctccctgaaatctcatacctaactaactgggaacaacatgtgaagctctccccagtcttccttgcattgtacccccacccctccaggcttcccctaagcttcaagcactgacacagacggagaaaccacctgcactccctgcaaatctacctcttcagctccatcatcaggctctttcccttcttgcatccctcaagatggactctacatcttagctggctctccaccagctgaaaccttttaggtgcttcttgccagttcttccactggtccagccatacttctcactggcatctcaagctcaaccccatagactccatgtggactgatggagtttgccttaagcccttacagagttgttacaacttcccccactaacttgatttcacggctaccctttatttcctcgccctctcttccccgccccatccataaacagccttacgagtttttgtttgtttttttgtttgtttgttttttttaatgaaacagggtctcattctgctgttatttaggctggagtgcagtggcacactcacagctcagtgcaaactcgacctcctgggctcaggtcatcctcccacctcagcctcccacatagctgggactagaggcgcccaccaccatgcccagctaatatgttttttgtgtattttttgtagaggtgggatttccctatgttgcccaggctggtcttggaacccttgggctcaagtgatctgcctgcctcagcctcctaaagggctgggattacatgcctagaccactgtgtctggcctgcttttaagttaaggtaagtactattaattttactcctatcacaactctcctttagctacctgaggcattgcaaacctgacttggacatttttggggtgttcacttgctggtatctgtatttcttgttactgtgggtgatcagatcaccgctcctacttattcatggatcttgagagatcatctgagatgtctttttgcttacagaccactcagttgcccttacttgacttctcttccacagtatttcttgaatccttcccttctgtgtaagtgtcatatggtcgctgttttggaaatgcaatgatggaagctcagccatcactggaaatctgtgggcccagggcaattcataagcctggacattgatgagtttgctacggaggtgcagcttctccctttccacgctacccaggaacactgtttgagaacaaaagactgaatcaggaatgcaaagagaagcacgaggcaggggagaagagaagaaaccctgttccactaaaaagaaacaaacagttgaaggctcatcacaccaagaagaggaaaggggagaggtagcagcttcttcaggagaggcagcagcacctgatgaatgcaacctatctatatgaatcacaaccagagtcagggggaaagggggaaggggtgggaggagctacaagaatgtacccctgaaagagaaaagagataaagagacaccacacccctggagtccctgaatagcaaagagactgtcataccccacagaaggagaaaccagagtctttggagaaaagtttcaggcttcttcatagaataggagaatgatctttaatgtacaaaggatagaactcctcagttggccttgaagtctgtgatggaggaagtgattgtgagagaactgcctggtcatcgatggccagggcaaacgacatgctagggtgctgagggagagagagagagagcacttgctaacaagactgtgagcttttatcatggagcattaaggaaccacagaaaactgcaaaaaaaaaaaaaaaaaaaaaaaaaaaagagccataaactactagatgggcatgtacttccaaatttccgaaggaaaattcctttaactgaatatcttatgtagctatggtttgcttgatgtggcccccctggaaaaattcaggaacatactattaaaagaatagtgagtgagtgcttagaaaaggaagccagcgcaaagtgtgtttaagacaaaagcaaaaaagagctcattaggagtagcttgctgtgttagaatagcttaccttttttgttggaagagctcaccaggcaggtggatcacagaaaagcaggcaagtgtttttgaacctcagcaaagcactaggcagcatctgttgtaaaatcttcatttacagcccagttatgtgattgcgtaaccaattaaaagactgaatctaaaggccatggataatggattaacaccctcccttacagagagggacctggaggcaagtcccagggctgcctcccggcttccttcactttttctcaatgatctggaggaggattgagaattcactcttaccacatttgcccctgagatagtgccagaaggtgatgagttctctgtagcatgaaattgagatccaaaaagatcttgacgagctcaagatggtcatgggaaatttaacagggataaatggcaagttctacatttgggttatctgctgaagtatagtgtggaggaaatgtggcttgagaaaaaaactagggactgttaattgcagtcatcttggtataattcagcagtgagctgggcctgccagcaatccagtaccatcatctcaggctgctctacaaactatgacctgtaggcatcagggtgaaggtgctgctttttgacaacccttaagcatggagctcagttcatatcagtcatatagacaagtagaggtatccaggctcttgagacaccagggtgatgaggaggcttataactgcatgcatgcatgcagccagtgaatgatctccctgggctgagacttgaacccagggctcccagttccaacttcagcgctttttagagaacacctgtgcaagactcagcaggcagcatgtctgctgcatactggataccaagccatggattcattttattctgattcttctgggtatattgacaaatgctgtgagaattggaaaacattttaatggaaagcaaagaccctattgaccttcgcagatgtgtgggctaccccctctaacttccaatgcccaagagaaactcagcagaaatactctctcataaaaagcaatttcttaaacgaatataaaatgaattccataaaccgccagaggcatcttcatcatttaaaaggtaagcgtcattaaaacaatacctttcagatgcattaaggttacatcgttaacaggactttactgtaccttaactttgaatacagaatacaatacagaatgaaaagtttgtctcttttctataccttttctacaattctctcatacttgctttgcataagcaaaaagaggaaggatgagtactggaatcagtatgacataggcagcttgattagatgaataaacaaatggctaattggatgaatgaactgcaaagtcttggcacacaactgcttattcggagtgtttctgaattgataatcaactatgcttacagtcgaggaatggtagtggatgacattccactggacagctctgtgggtctgaaacatgttaaagtaacatgcctttcaagctctagctgtgtgaatccttaaaccccagaaatataagtttgtatttgacccaaaatggagttaaatatttatccttgaaggaattggagcaaaaaaggctatcaaagttgtggaggtgctacagatttcgattttggagaaatcagttcagaagaaataaatacaatggacaaagtcaagctcaggagaaactagagctgcttactctctggctggctcaagatgtctcttcaggtgagcacagttgactgggggcccctgagaagaatggaataagcctgaaaccagatgttggtcgttttcctggaacttcctcctcctagttaactagcacattgcacatgtggcctcaacagttataagctttgtccaggggcatgttttcctgttgactccaggaggagagttttggtttttttcaaatgtcttgttcaccctgatatgagctcttgggcttatgggatagaatagttttgagcaacggatcaaatgatttacatctaagatctgcttgggactcggcaggttctcctttgctcaccatagatcacaacaatggaactttgtgtttgataaataggggaactcgacgtaacacaggcaatagaaatagaatcatattgttttaactgtggaaataaactcttcctaatttcaaccagggtagcctgttgaaagtgttcatgtcagttttcccttccagctctcttagaagccaaaagctggctggctgcaaaacactcgtcttgtctatttatcatgccatgcaacagaatggctgcctataaaattgcatttgtctttaatgcctgcttgtatgcgtttggttgcttacgttttcgaagggaagtgtctgggaaccatttccgaaatgcgcagcaattttcccactgtctttggaaaccagagccattgttgccaactcacaatagatacatatcttgaaaattaaattgttccctccaaagctggtggtagcagccttctctgttttctttcatttgtgaaataatatctaaaatatttgcaaagaagtggttccaagaatggagataatttatttcatcattataagtaatgaaagcacattttcttcacatgagatgggatttcacatgaagtctctaagcgcaacactacggtttttttcctattattctaaatccatctaaagagtggaatgtattaaggaagacaacttaaatgtgaactcttcacaaatcttttcttgcctcacatagtcttttttctttctttctttctttttttttattatactttaagttttagggtacatgttcacattgtgcaggttagttacatatgtatacatgtgccatgctggtgtgctgcacccactaactcgtcatctagcatgaggtatatctcccaatgctatccctcccccctaccccaccccacaacagtccccagagtgtgatattccccttcctgtgtccatgtgatctcattgttcaattcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcactgttggacatttgggttggttccaagtctttgctattttgaataatgccgcaataaacatatgtgtgcatgtgtctttatagcagcatgatttatagtcctttgggtatatacccagtaatgggatagctgggtcaaacggtatttctagttctagatccctgaggaatcgccacactgacttccacaatggttgaacgagtttacagtcccagcaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttttcttcttgtaaatttgtttgagttcattgtagattctggatattagccctttgtcagatgagtaggttgtgaaacttttctcccattttgtaggttgcctgttcactctgatggtagtttcttttgctgtgcagaagctctttagtttaattagatcccatttgtcaattttggcttttgttgccattacttttggtgttttagacatgaagtccttgtccatgcctttgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcagatttgtcaaagatcagatagttgtagatatgcagcattatttctgagggctctgttctgttccattgatctatatctccgttttggtaccagtaccatgctgttttggttactgtagccttgtagtatagtttgaagtcaggtactgtgatgtctccagctttgttcttttggcttaggattgacttggcgatgcaggctcttttttggttccatatgaactttaaagtagttttttccaattctgtgaagaaagtcattggtagcttgatggggatggcattgaatgtgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgctcctcgacacatacaccctcccaagactaaaccaggaagaagttgaatctctgaatagaccaataacaggagctgaaattgtggcaataatcaatagcttaccaaccaaaaagagtccaggaccagatggattcacagctgaattctaccagaggtacaaggaggaactggttccattccttctgaaactattccaatcaatagaaaaagagggaatcctccctaactcgttttatgaggccagcatcatcctgataccaaagccaggcagagacacaaccaaaaaagataattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaacgtaatccagcatataaacagaaccaaagacaaaaaccacatgattatctcaatagatgcagaaaaggcctttgacaaaattcaacaacgcttcatgctaaaaactctcaataaattaggtattgatgggacgtatttcaaaataataagagctatctatgacaaacccacagccaatatcgtactgaatgggcaaatactggaagcattccctttgaaaactggcacaagacagggatgccttctctcaccactcctattcaacatagtgttggaagttctggccagggcaatgaggcaggagaaggaaataaagggtattcaattaggaaaagaggaagtcaaattgtccctgtttgcagacgatatgattgtatatctagaaaaccccattgtctcagcccaaaatctccttaaaccacaatgacttttaacatctttgccttttctccactttctagatcaaaatcctctcactataactcaaattagttgaagtctctgtagctgtcacaataagagatgagataagggatgctgagatagagcaagaagtacattcctctggaagttctgagttctgacctccccagggaacttccattctgcacaaaagagtgctgaacccttccagtctgtgaccaagagggagctacttcagccctagagcagagtgaatttgtagatctcttaggccaccgtcttgtttctctgacaacagcatgtgacaactttttattctaatgagcgaacctccctgcaagaaaacagggcaggctgggtcctaaatataagatgattgagtaccaccaatgccagagttttacaaaatgaatgtctcctcatcagcccctcaatagcctctgaaagcctgctcaattgttctttcgcaccatttgtatgcatttgctggggctgccataacaaatgaccataaactgtggggcttaaaacaacagcaattcattctttcacagttctggaagccagaagtctgaaatccagatgttagcagggctgattccttctggaggctctgaggcctccatgccccattgccctctcctagcttctggtggcttccaagagttcttggtgttccttaaagatgcatcactcctatctctccctctgtcttcatatggctttctcttccctgtatgtctctgtgtccttctctgtctccaaatttccctctttttataactacactagtcatattggattaaggtttaccctaatggcctcttcttaacttgattacatctgcaaagatcctatttcccagtaaactcacattcacgggttctaagggttaagatttcaatgtattgttttgggggacacaattcaactcacagcccaattcaagtccttgtgttgaataccatccacagttgccgatgataatatttctatcacagattccagcccgcatctctgtatgagtgacacatcattcaaatctgtctttggagtaatagccatctgttaattctgcctctcaaccgtctgccaggtctgtgtccttccactgccccggtttatcctcatcatctcttccctggactcctgccacagccacctcccagggggcttcccctgcctccagtcttggctttcccatttgtcctccatactgtggtagagaaacctttccacaacactgctctgaccatcttccttgcttgaaaatatggtggcttcccactttctccagggaaagttccaaaggtttaccagcatgtcatactcagtgcttagcacagtacctagcacagagagggtgcttagggaagtgtttgtagactgacttctggctaaagagaccagagaaagatttccagcagaagtgacatctgagtgggaccctaaagagtgcatgagattctgataagggaagaagacagagtgggagatgcagacatggataaaaaagaactgccctacaggaactaaccttctataaataattacaccataaggctgcaagcactctgtaccttctatgtcataggacatagaaatgtcctatgagagttcacggaggaggtagtaatctatagtctgctttgtatttatagtcattggtgttatattgagttattggtctgatagcagtgtgtatatctctatatcccaattgtgtcaagtgcttagtagcatccattattgagtccacactgagagtaccccagggtaattactatcactgacagccttcctactgaaaataccagtgctcccagttccctgcaacccccactgatacagcaggaaagaaggaatatccacaactaatgttcgtatggacctttggaaagctagtgtatttttgctccttcgttccctgtcttcttcttcttcttcttcctcttcttcttcctcttcctcttcctcttcctcttcctcttcctcttcttcttcttcttcttcttcttcttcttcttcttcttcttcttcttcttcttcttcttcttcttcttcttcttcttcttcttcttctccttctcctccttctccttcttctcctctctctgtggtaagccatgaagtggtagatgtaggctggggccagcatcacaaaatgcgatggatattaggtgaaaaattttacccttcagtctgtgtgtgctggaacctggcagaactgttgcagaagggtcactgtgggtggagtgggtgctgagcaagcacggggtgataattttagaaagaaggggatggatttgactgacatatacatggaaaagtatgtgatgatcaaaatggccagaaataaaatgggctgcctcataaggtagtaagttacctgtccctggaaatatatgtccaagcatatgccatgaaacttcttaatggggatgttgaatagtgaatttaggcatcagaaatgaggttatgatagatgacttgatggttccatctaacacatagatttcatgaccatagcttccagaatgctagagaattattaggactgaatgaccaattagctggtaagggggtgtagagggatgagtcagaaataaattcagtgtctggtgagtgtccaagtgagggttggagtgatcagggaagaacacaagttgacctttgcacacattgagttgaaggtatgagaggactagctaaatgggtaggtgggatgaactgtcacaaatctgggtctgggctcaggtgatagggctaagatccagatttgaaagtcactagtttattccatattcccaaacaaccatgaaaggggaatacacaataggaaataaaaccttatctacaaaaaaaatcatccttagaaataaacgtgacatgcagtgtacaaaacctctacaaaggacattctaaaacactcctgaaagatgcaaaagtagacatgaatgaatggaaagacacaccttgctcttgaataggaggactcaacatcataaagatgtcagttctgtttaacaatttatacatataagatgaaatctcaatttttaaaataccaacaagttttttaattttgctagacaatttgatactaaattccatatggaaaaaaataaaacataaaagaagagccaggaaaacatactataggtcacttctggttctgaccaatatgaagtagccttacttctcccatgtctctctccttacaactaaacaaacctggagacattgcacgacaatgtgaatatacttaacaatactgaactatacacttgcaaatgattaagatagtaaattttatgtcatatgcattttaccacaatttaaagtgttttaaaaagcaaactacagaaacaaacaaaaatctgggcataacataataaaaaagcataaaaagcctctagaaagtagaaagaaaaggtgaccaacctagagtcctagacttgggaaataacatagcaatgagttccataggtttccatattgactcccatatattctggacaggacactacagaagcttccaacatggaactgtcaacaggcacaggcaaaagaaaaacaacaaaaaacaaaacaaagaaataaaaaccccacacaggtaggacgtagctgagctcaacaccaacaccatcgactggatataactgacatttaccaaacaacagtagatacacatacttcttaagctcatatggaacattcaccaagatggatctcattctgggccataaaataaacttttccaaatttagaagaacagaattcatacaatgtctgctctcagaccacgatggaattaaactagagatcaagaatagaaagataatgggaaaacgccaaaactcatggagattaaacaacacatttctaaataacacatgggtcaaaaatctcaggagaagttgaaaatatattttgaagaaaatgaaaacacaacttatcaaactttgtgtactgcagcaaaatcagtgataaagaagaaatttatagctttgaatgtaaatattagaaaagaagaggctaggtaggcatggtggctcacacctgtaatcccatcactttgggaggttgagctgggaagatcacttgaggtcaggagttcaagaccagtgtgggcagcatagcaagacaagcctccacaaaaaaaaaaaaaaaaaaaaaaaaaaaattagccaggtatggtggtgcatgcctgtagtcccaactactcaggaggctgaggtgggaggattgcttgagtgcacaagtttgagattacagtgagctatgatcgcaccattgcactccagcctgggcaaaaactgagacccagtctcaaaaaagaaaaaagaaaaaaaaaagcacattaaaccctaagtaagcagaataaaatatataatacaaattagagcagaaattaaaaacaggaaatcaatagagaaaaatcattgaaaccaaaagctagtttattaaaaagatcaataaagttgataagcctctggacaaagctaaggaaaaaaagagaacatgacctattaatattataaatgaaagtggggacatcattacagaccccatggacattcaaagcataataaaataatactgtgaacaaccctaggctcaccagtttgataacctagataaaatgagccaatttcttgaaagacacaatctgccaaacctcacacaagcagaaatatacaatcaaaacaaacctgtatctattaaagaaattgaatcaatagttaataacctttccaaacagaaggcgccaggcctggatgggttcactggtgagttctacataacacttaaggaagaaatgacacaaattctctacattatcttgcagagaatagaagcagagagaatatgttataactcaatttaatgaggccagcaacaccctaatacaaaaaccagacaaagacattacaaggaaagaaaactacagattcctatctgtcatgaacatagatggaaaaatgttcaatgaaatactgatgagtcaaatccaataatgtataaaaacaattatatactatgaccaaatggaatttatcctaggtatgcaagactgattatacatttaaaaaccaattaacgtcatccatcacatcagcaggctatagaggaaaaatcacatgatcatatcaatagatgcagaaaagccatttaacaaaatccaacacccattcatgataaaaactctcattaaactcagaattgagaacttcctcaacttgaaaaagaatatttacaaaaaaaaactgctactatcatacttaatggtaagagactagaagctttcctactaagattgggaacaaggcaagtatgtccactctcatcattccttttcaacattgttctggaagtcttagctaaagcaataagacaaaaaaaggaaacaaaaggtacacccattgggaacgcagaaataaaactgcctttgtttgcagatgacatgatcctctatgtagaaaatctgaaagaatcaacaacaacagcaacaaaaccattggaaccaataagtcattatagcaaggttacaggacacaaggtcaatcacattcttacataccagcaataacaagtggaatttaaaattaaaaaaaaccatattactgtttatatcagcacccccaaaatgaaatacttacatataaatctaagaaaatacgcacaagatctatataaggaaaacaaaaaatctgatgaaaaaatcaaagaactaaataaatggaaagagattccatgttcatgaataggaagactcaatattgttaagatgccagtttttcccaatttgatctatagattcagtgcaatcccaatcaatactccagcacattcttttgtggacaccaacaaacttattttaaagtttatgtggagaggcaaaagatccagaatagttagtaaaatattgacagagaagaacaaagtcaaaggactgacactacctgacctcaagacttactataaagatagaataatcaagacagtgtgctactggtaaaagaatatacaaatagatcaatgcagcagaatggagaacccagaaatagacccacaggaatatactcaactgttctttgacaaaggagcaaaggcagtaaaatggagcaaagatagtctgttcaacaaatagtgctagaacaactggacattgataagcaaaaaaaaaaaaaaaaaaaaaaaaaaggatgtagatatagaccttacacccctcacaaaaattaactcaaaatgaatcatagacataaatgcaaaagaaaaaattataaaactcctggagcataacataagaaaaaacttaaatcaccccggatgtggcaatgacttttagatacaacactaacggcacaaaccatgaaagaaagaattaataacctggacttcattaaaatggaaaacttcagctctgcaaagagaatgaaaagacaagccatagagtgggagaaaacatttacaaaagacacatcagataagggactgctgtccaaaatagacaaagaactcttaaaactcaacaatataagaaaacaaacaacctgattaaacaatgggccaaaggcttgaacagacatctcatcaaagaagatacacaaatggcaaataagaatgtgagaagatgctccacatcttatttctttaaggaaatgcaaattaaaacaacaatgagataacggctacacacctattagaatctggaaaactggcaacaacaaatactggtgaagatgtggagcagtaggagctctcattcattgctggtgggaatgcgaagtggtacagacacttggaaaacagtttggcattcttacaaaacgaaacatactcttaccatatgatctgacaatcatgctccttgacatttatccaaaggagttgaaaacctatgtcagcacaaaagcctgcacatggatatttatagtagctttatttataattgccaaaacttggaagcaacccagatgttcttcagtaggtgaatggataaactgtgacacatccaggcaatggaatattattcagcactaaaaataaatgagttattgagccatgaaaagacacagaggaatttcacatgtatattgctaagtgaaagatgccaatctgaaaaggctacataccgtatgattctgactatatgacattctggaaaaggaaaactatgaaggtagtaaaagatcagtggttgccagggattggaagggagggataaataggcagagcacagaggatttttaaggcaatgaaagtgatctgtgtattgtaatgatggatacatgtcatcatatatttgttcaaacttatagaatgtacagcatcaaaagtgaaccctaacgtagactatggactttgggtgacaatgatgtgtccatgtaggttcatcaattgtagcaaatgtgttattctgatacaggatgcaggtaatgggggaggggggaggctatgcacatgaaggggcaagaggtatattggaactctgtctttcttttaattttgctgtaatattaaagctgctgttaaaaaaagtattttttttttaattaaaaaactcctccaggaaaagccttttcccctagtaaaaggactgtggaaaaggtggcctaaataacagaaaacctttctgaaattacccaccctactttagtcaacaccaacagaaaaaccatccctctcctgtggtttcagcctagcaaagtgggaagttgatattccactccaccccatccccaattctcatgtaagcagatgtcggtcctctgattcccctgcccagaggtgtcaggggcccaagcatgctaccacttccccatcagggtagtgtaaggaaggtcaggaggggagttgagtctccactcccacctggcagacttaatgaggtggtacgagatggggctaaatcagcactagactttaccaagtaacccccacctcaggtattagtgaggtggattggaaacctttacttccacccctactcagtcctgcaagtcagggatggccagcagtccattttccacccaatcactggtatcagcaaagactagtggggagctgaacctccatacccttgcctagcagcaacaagactgaataaggaagaataggcagctctagactgcacttttgttcctccctttcaacttggtatcagatggacccagcagggatttgagatttctctttcaccttgcagcaaaaaggcaatatggatcagtctctatttccctcttccctagcatgggctggtgggaagctgggcttacatcctactcagtggcaacaaggcagggcaatttagtaccccactttccccagcagggcccagggtaagctgaacttccactccacctatcagcaataaggctttgtcagtcagcgctctattttgccagagtggtgttagtggggcctagcaagaaaatgaacaatatgtccacctggcccttacattacactttaacacaaagactgcccgctaaaaagtaaaattgaataccatccaaagtctcaaaatataatatgcaaattgtctagggtatgataataaaatcattaatcatacccagaaccaagaaaatcacaacaatgaatgagtaaagatgatcaacagatgtcaacaccaaggtgattcagatattagaattatttaacaagaatgttaaataaatcatcataaaaatgctcaaccagcaatcacaaatacacttcaaacaaattaatgaaatagaaaatctcagcaaagaaattgagattataaaaaagaaacaaatggatattaaagaactgaaaaatacaataacaaaaataaaataactcactggatgggttaattagtagtgtaaagatgaaagaagatagagttaatgagcttgaggacacatcagtataattcacccaacctgaacaacaaagagaaagtaatctaaagaaaacaaaacaaaacaatacaaaacaaaaaaaagaagaagaagaagagggggctcagggatctgtgggcaataacaaaagatccaaacgtttctatcattggaaacccagaaagagaggaagagcggagagagtaagaaaaattagtcaaagaaataatggctgaaaattttcaaaatttatgaaaaacataaacctacagattaaagaatctgagggatctaaacataataaacccaaagaaatccatgccaaggcacattgcatttaacattctgaaaactaaaagaagcagaaaaaaacccttatgagcaatcagagaataatggcacattacttaaagaggaacactaattcaaatgacagtggatttttcttcaggaaccatggagtacagaaggaagtggtacatttttcaagtgctgaaagaaaagaactgtcaaccccaaattatgtatctggcaaaaatatccttcaataatgaaggggaaataaaggtattttcagatgaagaaaaactaaaagatgttgttgctaagaatcccacccttaatgaatgcctaaaggaagttctcaaacagacaggaaatgataacagaaaaaggcttgaaactacataaagaaaagaagaaattcagaataggcaaacatagtgataagtataataaactatttttctcacgagtttattaaatcatcttggatgaatgaagcaaaagttataatgccatcttatttgatactgaatgtgtatagaggaaatatttaagataattacattttaaaagtaggaagggtagaaggacctaaatggaagtaaaatttccacacttcactcgaacttataaaatgtagactgtaaactatgataaattaatacatattctgtaatatctagagtaaatgctaagaaaattatacaatgtaatatgctaaaaaccataaaacataaaccaagatggaatcctaaaatagatttaagtaaagcatgagaatacaaagaagaaacaaatggaggacaagaaccagaggaagcaaagggtaaacaaataataaagtagcagacttaagccagaacatgtgaacaatacctcttatttatatggtctaaaacactaattaaagacagaggttggcagagtacaaagcatacgaaaattaaccaggcatggtggcgcatgtctgtagtcccagacacttgggagactgaggtgggaggatcacttgagcccaggagtttgaggacacagtgagcaacgattgcaccactgcactccagcctggtaacacagcaaatttgtctcaaaaaaacaaaaacaaaaacagacaaacaaacgaaaacatggccaaactctattctattactctaaatacaacatcataggtaagttgacagtaaaacaatggagaaaacataccatgcaaatattaattttacaaaagcattagtggctacattatcatcaaaaaagacttcagagcaaagaaaattattggagacaggcagacattacataatgataaaataataatgcactaggaaaacataatggtcctagatgtgtatgtaccaaacaatggagtctcaaaacacatgaagtagaaactgagagagctaaaaggagaaatggacaaatctacaattatagctgggtacttcagcactccactctcaacaacagatacaactgctagacagaatctgcaaagatgaagaactcaacaatacatcgtcaactgaaaggttctagatgacatttatggaacactccatccagcaacagcatattacgcatttgtttcaagtgttcatagaacatatactgagataggccacatcctgggccctaaaacacacctcaacaaatttaaaataattgaaatcacagcattctctaatgtgatcaatggaatcaaactagaaatcaataacagaaagaaatcaagaaaatcgccaaatacttggaaattaaacaacacacttcgtaataaaccatcagtcaaagaggaagtctccaagaaaatttaaaaatgcattgaaatgggccgggtacagtggttcacgcctgtaatcctagcacttcgggaggccagggtgggcggattgcctgagctcaggagttcgagaccagcctgggcaacatggcgaaacccatctttactaaaagtacaaaaaattagtcaggcgtggcagtgtgtgcctgtaatcccagctactcaggaggctgaagcatgagaatcacttgaaccctggaggcagaggttgcagtgagccgagatcatgccattgcacttcagcctgggcgacagagtgagattctgtctcaaaaaaaaaatgcattgaaatgaatgaaaatgaaaacagcagttataaagacatgtgggacatggctaacgcagagttgggagggaaatgtatagcactaaaagcatatgtacattaggaaaaacgaaaggtatcaaattaatatgtaagctaaatcaatcatgtaagcttatacttcaagaatctaagaagtgcaaaatatactcaaagcagcagaaggtaagaaataataaagataagataaaaatcaatggatttgaaaatagaaaagcaagagaaaatcaatgaagcaaaaagctagtttttttaaaaggtcaatacaattgacctctagcaagattgaaaagagagaagatacaaatcactactatcagaaatgaagcagagaatatcacagatctgacagaaatcaaaagaaaaataggggaatattaccaaaaactctacacagaaatttgacaacttagataaaatggaccaattccttgcacagcacaaactaccaaaataaacaatttgaatagcactatcactgttaaggaagttgaattcataattgtaaaactccctccaaaaatctccagacctagatggcttcattggagaattttattaaacattgaaaaagtaaaaccaaaccaattctgcacattctcttctgaaaaacagaagagcagggaatacttacttcccaatccattttatgaagttagtattaccctgatatgaaaatcaaaaagagtacaaaaaagaaaactacagaccaaaacccctcatgaatatagatgcaaaaatttataagaaattattagctaactgtcacaacttaaacaacatgaaatatataatctaaattgccctatataccttaaggaaatgaatttgtagttaaacactcttgaaaaggaaatatccatacctagatggtttcactggagaattttcccagatgtttaaagaagaattagtgccacttttacataatgtcttctagaaagtagaagagaaaggaagaattcccaactcattttataactctgataccaaaacaagacaaagacagtacagaaaaagacaattataaataaatatcttttatgaacttaaattttaaaaatcagcaaaagatttacaaataaaattcaggaatatataaaaagaataatacaccatgaccaagtggagtttatctcgggattgcaaggctggttcaccatttggaaacactccatgttatccacaatattaacagtttaaaaaagaaaaatcacaggatcataacagttgatgcagaaaaagcatttagcaaatttaacatccatttataataataaaaaaaatctcagaaagctaggaacaaacgagaacatcctgaacttgataacaagcatctacagaaactttacagataatattttacaatcctcccttggtatacatgaagggttggttccaggaccccactcatatatcaaaatccacacatactacagtcctacagtcagcccttcagaacctatgtgtgagcaaagtcagccctctgtatacgcatcccacaaatactgtattttcacaaattttagaaagcagtttggcttaaaaaatatcaaaataacaggagaagcagcttctgttgactaagaggtagcagagatgttcccagacaccatttctttggctttcttactgctttttattactacgtaaaaactggttggcagtttagcaggaagacttgtaaaagaagaatgacaaccaagaattttttgaccattaaatcagatttgataaacagtggaaggagtatggacttaaaacaaggcatgattattcagttttgtcaaaattttaccaaaatatgtgatatatatttatactaaaactatataatccttagattgagaaaagcaatcagttaatgtcttacctattaaacacaggtacaagttgaaaattgtagaaaattgaaagaaaacaaaagacaaaattaatgtctatagtaaggaataaaagagtttaagatattttaaaattatgtgtattttcttctcttttacataaatcatttttgaaaagtatgctgaaaatttttgagtaatattaattatgatttatttttcaatataatttggagatcctttgttatccaaaaaacagaaagaaagaaagaaaaaagaaaatcattgataagaaaggatatctgcctgaacaggatttaatgcagatgaaagtgccttatactggaaaaaaaaaaatgtcataaaggacatttagtagtaaggaagagaagcgagcaccaggatttaaggcaggaagggatagtctaactttgcaatttcgggcaaaggcagtccaggttcatgatcagggctgcccttatctataaaggtgctaacccctgagccttgaagggaaaagataaacaccagctgccgatctttttgttgcacagcaagaaggcctggacaataaaaaaatttttttctggattggttccatcgatcctttgtccctgaagacaggaagtaccttgtcagtaagagactgccttttaaagttcttttgatattggacaatgctcctggccacccagaactccatgggttcaacactgaaggtgttgaagtggtctacttgcccccaaacacaattctaattcagccttagatcagggggtcataaggacttctaagactcaccacacaggttactgtatagaaagattgtcaatgttttggaagagaacctcaatagaaagaacatcatgaaagtctggaaggattacactattgaatatgccataattgtttagaaaaacctgtgaaagccatcaagcctgaaacagtaaattactgctggaaaaagcaactgtgtccagatgttgtgcatgactttacagaatttatgacaataaacagggaaatcatgaaagaggttgtggatatggcaaaaaaaaaaaagatgggtgttgaaggatttcaagatatggatcttggagaaattatagagctaatagacaccatgccagaggaaataacagaagacaactttatggagatgagtgcttcctaactagtgctggaccatgaggacaaagacataaaagaagcagtgctgggaaacaaattgacattagacaattgaacagaagggttctgattactcaagacagcttctgacttcctttacagcatgaacccttctatgatacaggacctgaagctaaagcaaatggtggaagaaggattggtattatatagaaacattttttagagaaataaaaaagcaaaaagttagagagaaattatgatgtatttccataaatttgcactgggtgggcctgcctctcctgcctcctcttccacctccttcacttctgcctctgtcatccccaagacagcaagagcaacccttcctcttcctccttctcctcagtctactcaatatgaagataataaggatgaagacctttatgatgattccatttcatttagtgaatagtaaatatgtttactcttccatatgatttacttaataacctcttcttttctctaacttacttaattgtaagaacacagtatataatacatataacatatgaaatatgtgttgtttatgttattggtgaggcttccaggcaacagtaggctattggtagttaagtttttgggaagtcaaaagttataagtggatttgtgcctgtgcagggggttggtaccccaaaccactatgttgttcaagcataaactctgtgtgtgtgtgtgtgtgtgtgtgtgtgtgtgtgtgtagtattgttcaggcataaagaagaaatcctgccattttcaacaacatggatgaacctgcatgacctgaagtggaaataagccagacaaagaagacaaataatatatggtctcacttatatgtagaaatttaaaatgctgaactcctagaagcagagagtagaatagtggttgttaatgtcttagaggtgggggaaatgggaagatcttggtgaaagtgtgcaaaccttcagttataagatgaataagttctgggaatctaatgtacagcatggtgactatagttagtagtactgcattgttcccttgaaacttgctaagagggcagattttaagtgtcctcaccacacacatatatacacaaaaaaatggtaattatgagaggtaatggatgtgttaattaatttgattgtggtaatcattacacaatatatacatatatcgaatcatgtacaccttgaatatacacaatttttattaactaaacattttaaaatttaaaaactcaaaatggaagataaatctaaatgtaagaactaaaactataaaactcttggaagaaacatagaaatatatctttgactttgggttaagaaatagtttcttagatatgatacaaaaagcacaagtgagaaaagaaaaactaaataaattagctttcatcaaaattaaaatttttgtgctgcgaataataccatcaaggaagtgtaaatatgacccacagaatgggagcaaatatttgcaactcttatatctgatgaaggtctagaattcagaatatataaacaatgcttacagttcaacaatagaaagacaaataatccaatataaaaatgggcaaaggctctgcataaacacttctccaaagaagatatacaaatggccaataaagcacgtgaaaagatgctcaaaatcatagccaacagggaaatgcaaatcacaatcataatgaaataccactttatgctcactagaacagccataataaaaaagacagaaatttacaagtgttggcaaggatgtggagaaactggaactcttatatattgttggtgagattgttaaatggcacaactactttggaacagtttggcagttcctcaaaatgctaaacatagagttaccatatgatgcaaaaattccattcctaggtatatgcccaagagaaatgaaagcatatgtccacacaaaaacttgtacatgaatgttaacaacagcattattcataagaatcaaaaagtgataacagctcaaatttctatcaactgatgaatggagaaacaacatatggtgtatcacaaataatatgtggaatattatttggcaaagaaaaggaatgaagtactaatacaagctacaacatggatgaagcttgaaaacattatgctaagggaaagaagtcagtcacaaaaggctatttatcttatggttttatttataggaaatacctagaataagtaaatccatatagaccgaaagcatattaatagttactaagggcttgggcagggggtaattgaggatgtttgctaatggatatgtggttccttttcagggtaactaaaatattctgaaattagatactggtgatgatggtacaactatgaatatactaaaagccactgaactgaatattttaaatgggtgaattcggtggtatgtgaatggtatcaataaaactgtgttaagagaacacataccatttacaactgctgcatagaaaatgcaatacttagatatttaatataatataatgtgtataggatctgcatccagaaagttacaaaatgcttttgtaagaaataaagactcctgtgcatgtatcctggaacttaaaataaaataaaatataaaaaatcaaagaggagcacaatgagatttcctgtgacctattaaaatccataaaatttatcaaagaaatttacatacgaagtaaatcttgatagtagttccaatcacaataaattatacttgcaactgacatttataagcaatttcttttctctctttaaaaaaactctatattttctttatgaaaatagtgattttttaaaactctactctaaaatgggacagggccgggcgcggtggctcacgcctgtaatcccagcactttgggaggccgaggcgggcggatcacgaggtcaggagatcgagaccatcctggctaacacggtgaaaccccgtctctactaaaaatacaagaaattagccgggcgtggtggcgggcgcctgtagtcccagctactcgggaggctgaggcaggagaatggcgtgaacccgggaggcggagcttgcagtgagccgagatcgcgccactgcagtccagcctgggcgacagagcgagactccgtctcaaaaaaaaaaaaaataaaaaaaaaaaaaaaaaaaaaaaaaaataaaatgggacaaaatatttgtaatctgaagtgtttcaaattttgtactctattgctgcagtcttatactacatcaacaagtatgaatacatttataagaatatatttaaaatattttcacttattgtatttcccttgaaaatattgacatttttgaattttaataaaaagaattcagaaaaaaagagttgaacatcaaatagaaataataataaacaccttttttgtgctcataaaagaataaagacctaaataaaagaggagacatactatgtttactgcctagaagactcaacatagtaaagatgtcaattcttgaattgacctgtaggtttaatgcagttctcatcaaaatctcagcaaagttttttgtagacgtagacaaggttattctaaaatatatggaaaggcacaagtcctaggttaaaacaattttgagaaacaattatacaatgggaggagtacttttacccagtattaacatttttatatggctacattagtcaagactgtgtggtattggcagagggatagacacatagatcagtggagcagaataaggagcccagaaatagacccataaaaatatttcccacgaatttttgacaaaggtgtaaaagcagttcagtgaggtggggatagccttttcaacaaatgctactagagccattgagcatccataggcaaaaaaataataaacatcaacctaaacctcacaccttatacaaaaatcaactcaaaatcgattatggccttaaatgtgtaaccatcaaacttaaaaaatattagagaaaattttcaggacctaagacttggggtagagttcttagactcaaccacaaaaatctgacccccaaaatagtctttttgtgaaagaacctattaaaaggagggaaagataagatacagactgagagaaagtattttcaaattacatattggacaaaatacaagtatctagaatatataaagaacttgcaaaactcaacagtgaaaaaaaagagaaaaaatgcaaataatccaactagaaaatgggccaaagtcatgaacagacattccgtgaagttatatggatgaaaaataaactccagaaaatatgttcaatctcattaggcgttagggaaatgcaaattaatatgacaatgagatatctctacacacctgtgagaatggactactcctgtattgcactacaccactatcagaattatgctgagggaaaaaagccaatctcaagagatcacatgctatatgattgaatttacataacattcttgaaataacaaaactataggaatggagaacagattactggttagttgccatgggttcagaagttggggtagagcagatcaggagggaagtgggtttggtataaaacagcaacacaaaggattgcatatccttgtggtgatggcactatttctttttcttgactgtggtcacatgactctacacatttgataaaactgctttgaattaaatactcacacatgtacacaaataagtgcatgtataactggtaaactctgaataaggtggatggagtgtatcaatgtgactgtcctggctgtgaactgggtgaagggtaaataggatctttctagtattgtttcctaaaactgtatgtgactctacaattatctcaaaataaaaggctgttaaaaatcacaataaagcctctataattaaaacagtgtggtactggaagaagaataggcaaattgaccagtggaataaaatatgcatgtagaaatagacccaagtatatgtggagactgaatatataataatggtgacttttcaaatcactggagcaagatgaacatttgtaaaatggggctgcgatagctgggtagtctcttgaaaaaagggaaggggatgggtgctgtggctcatgcctataatcccagcattttggaaggctgagacaggaggaacgcctaagcccaggagtttgagaccagcctgagcaacatagcaatatccactctctacaaaacattaaaaaaaaaaaaatttagccaagtgtggttgtggcacaccaccccaccactgactatgactatgccactgcactccggactgggtgaaagagtgacaccctgtctctaaaaaagaataaaaaagagaaacaaaaagaaaaaaggaaagaggtaaagtaagatccctcccatataccattcataagaataaactccaaatggattaggaatctaaatgtaaaacatgaaaccatacaaatactggaagaaaatttggtgaatttctctttaaactggatgtgaggaaaggctttctaactgtgattcaaatccggatatgataaaagaaaagactgatacttgacgacataaaaaaattttttgcatggcaaaacaaaacaaacattgaaaaaaaccacaaaccaattaagtgaaattacttgcaacatatatcacaaataaaaaaagctaatatacctaacacagaaaaatactcttaaaattgagggtaaaagactaaaaacccaatagaaaaagggagaaaagacatgaacagataattcacacacataaaaatatcaaaagggctcttaagcatatgaaaagatgttccaagccactcctaattagaaaaatgctaattaaactacactgagataccatttctcacctatcagatttgtaaaaattaaaaagtaaagcaaatactttgttggtgaggctttggggaaaaaaacactctcatacattgctaatgggaatgcaaattggtacaatctttctggaggggaatttggcaatacctaacaaaactacatttgtttttacattttgacacattaatcccacttatagaaatgtactctttaagatatacctctaacaatatgaaaatacatatgtactgggttgtttgttttatttttaattgcaaaatattggaaacaatctaaatggctacacataggaggttggttgaataatctatggtacatctacacaatgcagtactatgcagctgtaatgaaagaatgaagaagatctctatatggagtgatttctgggacatgcgtttgagtgaacaagcaaagctcaaaagagtatgtctattaagccacccttatgtaaggaaggggtatgggaaaatacacagatatctgttcatttgtgcaaaaggaaacacagaaaagctaatgaagttggttacttacaggaaatgagtggaatgaggtggaaaggacagaagtaatgggagatgtcacttttctgaggatttctttttgtacagttctaacttttgaaactatgttattatttcacatgctcacagaaaaataattaaaattaacaaagaaagatggttcaggggtggggggcagacaaaaaggaatctaaacagaaacaagtgaactaaaccatattcaaatgacctcagtggggcccgggagatgaactagcccaggtaactttttaacagtgcttgaaggattcactcttacgaaaagacaaaaataattctgaacaaatattgtactcttgtcaattggcttcttcatagagtcatgggttagcaactctgaaactagcttctatatattctaggattaagtgagtaaatatattatggtaatggcagagagatttctcactgttttgcaaggaaactacaaatatgggaagggggaagatagaatgaactttgctgttgtattggaatttggaggttatcagtgtgaactcatggtttatgggtaagtaggtaggcaggtagatagatagatagagaaatagatattaccaaaataataaataaaaaggaatagatatagatgtgagttaattattttcctagctttgtggactgagagggtttagtaacaatgccacatctgtagaaatgcgcatgcttttagtacccagatcttagtttttaaataccattcttcactaaaagaagttaagattccatgggaaaatggctgatattaaggctaaggcagggaaagcacaagatgagcctggagcagatgtgccagaaattaagggcgcgctcagaggatgattaggggcatgtcagaaagacataggaactagtttgaaggagttcccacgggacaaacctcaggcaatttgagcatcaaaataaataatgataggaaaggattataactcaaagtaaaaatgcacaagtcaacctaatataaataaaagcataagtaaataaatgggagtgaaagaaaagttctttcttatagtagaaagtcaactaataaatgtagaatggatgatggaatcagaaattcattatttggcaaccagcataatgcactgaccatcttgccccaggcacagaccatcaataaatgctaaactagtgagtgaaagtttgaggtgtactaggatactaacagcctcaaaatatatttatttccccaagatactcattaattgcaacgggaagaaataggaactggacagtggagatatctggcagacatcaccttaaccaagtgatcaaagtgacaatcaccaggaataggatgaatggaactaacatcgtggacctcctgatatgatacactgatggacaacatcacttctgtggtatttctgccaatagtacataaccctgatctaactatgaggaaacatcaggcaacaaactcaaactgagggactttatgcaaaataactggcgtgtactcttcagaaatgtcaatgctacaaaacactaagacagattgaggaaccattcaacattaaaggacactaaagagacaaaacgactgaatgcactgcatgatcctggattttcttttgctataaaggacattattaggacaattggcaaaatctgaataaagcctttagattaaagtctttagatagattagtaccactattagcttcctgattttgatcaatatgtgcttatgcaggagaacgttttaggaaatgttaggaaatatataatgcagtatttggagataaaagagcatcatacctacaatttgttctcataaagttcagaataaaattgtgtgtgtgtgtgtgtgtgtgtgtgtgtgtgtgtgtgtgagggggtggtagatataacatagaatgtggtaaaatgttaacatttggggaatcaagtgaaaggtatttaaacattatttgtattattcttgcaaatattctgagagtctgaatttatgtcaagtgaaaaattaaattaaaaaaagagttagaagtgatcaattaatctcctagggagaaggtattgagatcaaagattaaaggcctgaggggaaaccattagaaaatgctcacagctgatgggtgagtttctaagaaacagcaggacaagagtctccaggcacagtgggtattcaaagagtggtaactgttgttttcataaatttcagaaagtactagttcatctcagagatatagacctcctaactctttcagaaacatcactaaatattgcttctagaaaggatttaaaggtcatgtactgtactggtcaagtcacatcttccaaatataacaatctaacataataagaggaaaattccacaaagcccctttaggtcagcctcctctttgtaacagtgggaaccgtgaggcccagagaggggaagggacttgcccaaggtcacacagcaaggcagtagagctgggccaggcaccagggtgcctccctccaaggccaaggcctctctgactctgcacctccatacagtctggcttcaggccagaggagtggatggctgggaactagacaagaggtagctgggctggagctgagagatacagtcccaaagttggtggctgttcgggaatgagtggggcgcattttgtgaacatcccataagctataggtggccaacacatttatgtgattaaaaatacaaaataaggctgaatacgctgggtgcaaacagttgagaaaataaaagcttcttttagacaagacaaactgttactcagtacaaaaataagggtggggtggcttgggattgttttttttttttttccataatgaaaattagcaaatatgaagtcaaacctaaaacagcccatctgtttgaaataaaataaatccaaataacaagcccctaaggaccaccccccaatattcaaaaaatctgttttattttaaattaggcattggtacaaaaccaagaaaattaaatatttactgttaacagagaacccttggatgttgggggcaggggtggagaataaaaattccattctgataagctagtatctgatagctagaaatcagaatcactcagccctatattctgctgactgcaggtcccatttggagttgagggcctggaggcttcttctgtaagatcctaggaagtgcggtgtggggcaagcagtgggttgcaagctgggcctcctgggtcctggaccacctcagctcctagcagcttgccagggaagcctgggcaagcatgatatttttcttcagctgcagcatcctcaagcataaaacaaggggtctctaaaggaatttttttctattatttggtcctacataaatacatgtcaactttgtctttagctaaaacttctaaaactgttatcacttatgtaacagtcacagtccccacctacccaaacaaaaatacaaccccatgctttcaagtctctggtaatttcaaaaagaacaaattattacttatccttttcaaatattttaagtaacttagagtttaacttgctactggagaattcagaaatgccagagctggaggagccctttggatgcccctacaccattccttcattgtacagatggagaaaatgatgcccagtctgaggaaatagcttgccccaagtgccatggctagttggtatcaaagctgaagccagaccacatgtcggtggccctcaggtgggtattcttcccactgtagcaccagggactcctcccagactcagaaagctggtctgaaacagtgaatcttccaaagggcaaccacccactgccaaactttccaatttacaaactactctcattttgtttgatgacgtgatggacctaaaattcctaggtggcatctgctttcaactgacttgcacgattcctctccctccagattaataatgaaattaagggtgagatgctctgccaaggatgggaatgggagccactctgcgtagtgaccctgtgctaagcactctttttcaacatgatctccacttaactacccgtggcaaatcgggttggtttaacaaaagaaagaatgggtagggagacacctcaatctgtttgcaaggcaattcaaagcaaaaacagttctctctttctaaaggagagggaaagcccaagctcctagcaacacatttctttccaaaaggttcctaaaatgcacatggggtgggggaagggacttaaaagctctgcaaatgcgtggcagcctccactttggaactgcatagcaacaggctgagcaaggccaggatctccctctgagggttcaaagggctttccaaacctgctatttactttctagggctgactttgaggacctgagcattcatcagggccaggttaatatgatgatgggcttgtgtttctaggagaattgaaaatacactattgtgaggagccagacagagaacttggaaggtgcacaggatcaacaagggccaaggaaatgtcttcatgacttgtcatgagacccagggccagcacctgctcctctctgggcctcagtttccccatctttgatatatgagccctcgtggccttgccatgagaagactttccacacttccagggttagacggggaaggttgtggaagtcttatttgaatggagtccagccatcctcttccctcctaagcagaccccccacacaccagcaggcccaacctgaggctcctctccaaaaggacacgaccccacttcctcaggatggggccctggacagatcctggggtgagactacttcccagttttcatgagggtctggctaggccctttcagtgactatgagagagacacccaggatccactttaccttctcatgcccggtgtgaccgtactgaaatgtgaaaaaccaaacaactatctgcctcctcagatcccattttctcacttctgcagcaggcaaatgtggaacctcctcaaggcactggactggctacacacatccttgacccattctggaactgccgagggctgggtaattgggatctctaaaactgtctagatcctggacacactgcatgctctttgaggtccctcccaagccagagtctctttaatgccagtttgcctgggcgtaacttatgcagtatcaaagaaagggacaaaatgacttttcaagtcaaaagaagcctgattttctcttgttaaatttctcacatcaaatggaaatgcaaaataaatagtaaacactgacactaaagagagcaacccatgagtgtgccctgagcctgatatttacaggaccatctcaccaacaccgtctcttttgaatctcccacaatgctccaaacttggtggaactgacattctgatatttccatctgacaactgagggcactgagacttggcaggttcacagacttgcctaaaatcccacagttggtcaatgtctcctgccgaaagctcatattgaggctttcttaacctgtgacaaaagatcctcgagagaaccatgagtgggcttaaggcctagtagtaccctaaattagatgcaacattgcgtgttatttttcaattgtctaaggagaagacccagagttttcatcagattcacaaagaagtctgtgatccctaagaggcaaacagccactcctgcttcagaggatagggagtcatttttgttatgatttgaggttcaagagaccaactggggttagcttccctgagggcaagctcagaaaaaccttggcaaccaggcagttctctaactcataaataggaccagctttatgccaggcatggtaccatttggtggggtggagggtggggtgtggattagagggcttccctaagccctgaatacctccttacctgtgccctaaacagcagattctctccaaggcatggtaactcttgcatcttttaattcaagttagaggctccagattctccagaggaagggaatcccactaaggtacagcgggctgaggatggcatctttctaggtaaggtggagagggggtgtgagaagcaggaggcaagtctagaaaccggtaaggaaaatgtaggggtactgaacctaaactcgatttgctcgggatttggcagccaaaggcatggctgaaaatgccagtgagcctgtccccagccatatgcagaatagggcttcagacctagcctttgctatcttggcaaagttctactcctgagagagggtgagtgtgtgagtgtgtctgtgtgtgtgtacctgtgtgtgtgtgtgtgtgtgagagagagagagagagctcttcacaaccacctgagcaaggagatgagaactcaaatggctaacctggccaactctcaaatcccacaaatcagcttcggtggacccaaactaggcaaccaacaatgctgctaagtctccccaaccagggcctgagaatgcagtcttctcaagcacccagaatggggaacgggcctcccactctgggatccactgctgctgtttgggaaggtggggataaaagagatatgtgggactgccaaagggctgttactcttggggattgctggtgcgggacgcccaggaagagcaggcaggaggagggagaaaagcctgcctggagaatccccattaacttcatcttgtgatttcattgtcacagccactcagaacaggtttggccccaggggcaggctcttgggagcctccgatttgataatgtgctcacctcgtgctgtgggacaagacctcaccacgagccctattagtgggtgagaaaggactccctggctgccctattgcacagggcatcagtcatactccaaaactaacaccccagccatgtgctcgggtgttacctttgtgtctggtgctcccctggtgggattagtgcagtgacactccttgatattttcagggctcatttcgagaactgtcatggcaactaacatgataatgctctttaccccatggctgggggatcactagaaacaaccagattgttcactttagctcgaatgtcagcacaattattttaacaccaagtgtgtcaggtttgactccgtattccggaaattaattttagagtggcagggaaataaaatggcatacttctttgagctttgttacaacatgttcgtgcagcaaactgcgaagaaaatgtagtaattagaggttaaattaatccttgacagacaagcagcttagaaacgctgtgccctcctcccgaagcctagcataaagcatgccagtctttcagaattagacacgcaaaccatgtgacgttggcaactgcaccaaaactactgtcccacttaaaattccgaggctggtgctggaacttccagaggcagatattaacactgagatctcattaagagccaaacccaaacaacctcccaccattgccagaggagcccacccagccaagccctccacagggctggctgcctgactctctgacagcaactcgaaaacgagacacacactaccttctaattcttaatttacaatctccattctccagctacttccagacttcgagttcagattctaatatgcccctttgctgtcctaacaatgctgagcaaagcacacgttgatacagggtagattatattacgccacagttacaagcgctccccctccattggctgcatttctttttaccacatttgctctgcctcaaaaggaaagcctgtctgctcacacatgggtgcaaaatggatgttctacacttgactgagaactagagaccagggttctgtcaactttgggctccctttactatgtccccataggaaagtcagacgcttctctgggcctcagtttcctcttctgtaaaatcatggggttttactcttccagctgtaagattctccatctttcaacatctgagtttgcaggtgaggtggtgcacctgtgctaactatgtacaggtgcaatggtcaactgactggcatagccacagaaaggaaggcagagctgggtcctgtcttcctcctccccactctgtcacagcacgctgccgaagctgagagtggaatttcggattcaaatgcaggaaaaaatagaaatgcattacttgtggggtgagggtggagctgggacaattggaccaagaacttggaattcctcaatgtgttcagaattacttgactttgtttttttcctgtctttatgctccaaagacccacactttcctctcacaggtgaacacaagctggggccaccaggcctttttgacctggatgccattaactagctcaggtgctgtggcctccaatgatctcttccaaaatcagcagaaaactgtccctgtggtctagtgtctaggtactcgcacaggtggaagaaaggggaaaaaatcaacggctggcctgctaggccctcttccaacaagatgatatcacctggtccactccatccttctctgaacctcagggaacaattctcagccttaagaaaatggcctttcccaaaatccacttactggttatttacttggcagaacaagcagcagggcacatgggagggtaaggtagcttaccccacctgcccaccaaggaaatgggggtctgggaggctccaactgggctgtgcagaaaggggcactggctgtgtccaggtcagagggcagccgggcaggactgagttgccttggtgggtgggtggggggtcctcctccaggggtatgaagagcccaccctcttgcaggccgaggaagggagggagtagtctgaagctggggcctcagggaggctcaagatagccaatctgggcaaggaaagctctcctaaactttgcaaagagctttttgcttcttgctcccaaaccctccttaggccctgtctctggaagcctttactctgggagctcagtgcctacagccagggaggccccttgctattccctcccccggggggaatatttttgaactgtttcatatctgattgctttggatgttataaagatgtcagattttaggagaaaactcgaggtttgaaggaaaccagggaggctctgtgaaggggagaaagaaagcaaccagagctgggggggtggaggcagggaaataaggtaacccaactcttttgcttctgtctccacctctggaagaaaatgctcttggggcttcagcagccctgggctggtaatttgggagcaggaccccacaggactatgcacctccaatcttggcatgtaaatatcctataacacaagctactgtttcttacctccatggagaaccccctgactaactgtcctgacagctccatggggccttttcttcttcctttgacacctttacagactaaagaacaacaatgacacaacaaaaataagaagtaataagtatttgcaacacagtctcttcaggttcattcggatttatgaaattttcctcctcgaagtactgaagatgtttaaggacccaatgcctacaaaaccaggccagttccaattgagctttgcaatgcttttttcctgccatacagttgactggtgctgcctaggttacccctcggtggcgttgtgagaggtgtatgatgggaattggtttattgtgctgatccatagtaaccggctcctgttcctccatcatttatctccctccccagtgacatctgggttggtctattcacactctcagcattctatctgctccaacaaacactcagccttttctgcttggataaggagttttttagttacatccattatatgtgtatcaacatttatggcagcaagataattgccaaagaactcagaggataaagagtccttcttcataatgttcacccctgcccctttaaaaaatcaatattaacatcaagtaggacagcagcaggttcttacatggctgctgtatccccaaagttggaaatgtgattaaaaaaaaaaacagctggattaggaagaaaagaaaaggttcaacaatgggttcagaacccacaccccagtggtgcacgtgtgtgtggatggaaggcctttttgtctttgaaaccttcactaaataactgcaaagcagcaaatctgctctacattagatgagtcctttggaaatatgccagtctactctaaagagtttagatcccgttatctgtataccaacccaatgattaggaggcctgccatcaataggagtactggacaagagaaactttgggttgatttctgatgtctgctgtctctgattctgggttagaagttcacacttgcaaaagacacaaaaaggtgaacacttcacacttttgtattgttttgattggccttctgccatttttttactcctcctttttatccttgcccttcaaaatatcagcccctttttattatctgtctagctgtttcccaatgacaaggttgaacttgatgtttcactttcccagaaaatgactatttcattcacaaaccatagtgttttagaactggaagggactcagactcagaggtcatgggattgggggagagaaaggatggacttgtccaagatcactctgttaattagtgggcagaactttctagaacacaagtttcccagctcctaggctaatgatctgtgcaatgcactgttgcagaaaaaaaaaaaatcagaatcttaaaaaaaaagggtttattcaatgccatccccatcaagctaccaatgactttcttcacagaattggaaaaaactactttaaagttcatatggaaccaaaaaagagcctgcattgccaagacaatcctaagccaaaagaacaaagctggaggcatcatgctacctgacttcaaactatactacaaggctacagtaaccaaaacagcatggtactggtaccaaagcagagatatagaccaatggaacagaacagagccctcagaaataataccacacatctacaaccatctgatctttgacaaacctgacaaaaacaagaaatggggaaaggattccctatttaataaaagatgctgggaaaactggctagccatatgtagaaagctgaaactggatcccttccttataccttatacaaaaattaattcaagatggattaaagacttaaatgtgagacctaaaaccataaaaaccctagaagaaaacctaggcaatgccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacgggcaacctacagaacgggagaaaatttttgcaatctactcatctgacaaagggctaatatacagaatctacaaagaactcaaacaaatttacaagaaaaaaaaaaaacaaccccatcaaaaattgggcgaaggatatgaacagacacttctcaaaagaagacatttacgcagccagcagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagacagtgtggcaattcctcaaggatctagaagtagaaataccatttgacccagccatcccattactgggtatatacccaaaggattataaatcatgctgctataaagacacatgcacacgtatgtttattgtggcactattcacaatagcaaagacttggaaccaacccaaatgtccatcaatgatagactggcttaagaaaatgtggcacatatacaccatggaatactacgcagccataaaaaaggatgagttcatgtcctttgtagggacatggatgaagctagaaaccatcattctcagcaaactatcgcaaggacaaaaaaccaaacaccgcatgttctcactcataggtgggaattgaacaatgagaacacatggacacaggaaggggaacatcacacaccggggcctgtcgtggggtggggggaggagggagggacagcattaggagatatacctaatgttaaatgacgagttaatgggtgcagcacaccaacatggcacatgtatacatatgtaacaaacctgcacgttgtgcacatgtaccctagaacttaaagtgcaataataaaaaaaggttttactgtatattgaggctcctttaaagaagaggcatagtccagctattttcagaagagccacttgtctaagaccagtttattccctttcataaccccaaatagtaattgagtttcctagggaccatccattaacaggtgcattttatgcctttaggtgatcaatttaaaagggaagaaaatacattaaacatgctggctaagctaaaaaaatccctttccttagtaaaaaggattgacagtagtgaatctcctaccttaagttgcagtgaatctgtagaccccacccccaccccagaaacagggtatttcctggtggagtgtaaaaattcaatgacgttcctatttcaacccacacatctgtgtcactgtcagcgtcagtggcaggaaaacagacgaagtcaccctttgctaatgatttcctaacatggaatttccttgtatctcctaaaggctttcttcttccaacgccaaactcttccccaccccccaccccaacacattgtactgaagaaaaactgaaaatggtcacagccggaagaggatgatttttaaggagatcttgtaaggaaaagcttcagctctttgtgatatttttaaagggggaaaggggggaaagaatgctagttttttccgaagctgaacaaaacagagagatttcctcccaggcatctggaaatctctcagccccacctctttctttcttttttcctgcctcgtctgtcccaagttccactttgagcaacattcttacttcagtactgaaagaaacactcgcacatcgcaggcaggcaccgggagagggcagggcggcccccagagcagggagcaggcattggagaaccaccaagcacaaagcagtataggagcccatcacttttcccctctggagaatatcctatttaatatgcaaactggtcatgaagtgaaaagagggctgttactttaaggggaagaagctgattagctgctctggctggcagcaaacagctggtctgtccggcaggttcaaggccatttcagcttctctcttatggaggcaccatatgttccatctcgcacatcagcagctttattttccaatgatcttgctccagaagagaagcacaaaggagggaggagaaggcagaaccagtagtttaccctttgattactttcttgtggttttagatgcagttgggatgtgtgtatgcgcgcatttgggatgtgtgtatgcgcgttgggggtgttaacgcttcatcttctactccaaagacgcagaaaacaaatgtttgagcagcacttatcaataacctccagagatgggaggggaggggagtaggagaaagatatgcaaaaaggcacaaataaaacgtcgacatcagattaaatggaagtaggaggggcggaggcggccagagagcgggtggaatctgacttcgcttgggagacccaccagcctgagcctgggccccgcccactttccttatttgtcacttttttcttttcagtattcccttcccgaacaaactctatgagagacaccgaccactttggggcacaggggcggagcaggccaacagaatggcgaaaggttacttctaacattatatttgacattcctcagtgcaagccctggttctcgaaagttttaggggggcagttataagggacaaggacccgctaaatggtcaatctaactaaagctggcagctttagtgtcaggcgctgggttaggtgcagaggcagcaggccagcgcgcagtccagagtagcacgctcatcctcactgcccgcctaggctacacgaaccccggaggtggcggctcccactgcctccgcgcctccaaacaaagggcgctcggagagtttgagcccttgtgtgtggtggggcggagggtgtggcaggagggcgcgggaagaaatgaggcgtgtagccagacgcgggtggcctaagcctccgagctgccgcctccgtcttagccaccggcgggcgcgacagctgccctgagctccggcggcgaggggcgcccgctgcaaagcgaaaccaaggaaagggcgccccctatgcccgagcccggcgagcgcatcggcgagtcgcgtctgcccaccccgcggagcgcttgcagcctagggcctctgcgcgcgcccgccagctcgcagtgcagtccactcggccgtcccggccgccaggatttagggtgtccagggctggcaggccgggcgtgcagcgagggccggggctgaggctccgtgcgccttcgtgggttcccacagagggtcctcgaaacacagccccctcccccatcgcctacacttgccctcctgtcccgagcggctcgaaaccacttggagacagccgcccccgccctctgcctctgcgtcccttttccccttccctctctccagcctcctgggaaacaaaggggctttttataaagcggattgttggcggcggcggcggcgggggtgggagggaggggggatctataaagacaagaagaggtgggagggagggaaggaaagaagctgcgcggcctccaggggcccagagctgcggtggcggccgggaagccccggcgggtgcacggtcgaccccgcccggccggtgggcactcgggcggcaacccacgcctgccaagagctgggccgcgccgctgcgatgtcgctcgccggctcaccgcaaccagggaacacaattccccaggcgcgggccggggccgctgggggcggcgcaattcccgcgggggtctaccccgggagacccaggccctctccctagccaactctttcaaaattgcttggtctcagggagactttgcgcctttgttccagcgcagccgcctctagtaagctcggctcgctcgcccttgcagacaatgtcccggagccggcctgggtttgcctacccgtgagcagcacgttcaccgtggggaccgcgcccccggggggcaccgtggtgccaaacaacaacgacaagccaccccagcaaaagcagccccttctccccacgtcccccagccacgctgtgctcccgcccgctcacacacacccacactccgggtgcccaggtcagccgcacccagctgcagaagcgcggcggggcgggagtgaatgctccagcccgaggcgcgtgtttgcacaggttccgatggcttcagggccgagctttctggcaggctaatcctattagtgtctgctcagtccgaatttaatcacggatcagaatcagacgacatctccagctttccaggaggcttcggacacactgcattgggacggagcctggccaagccaactggccgagaaaagtatttggcggcgctccggggggcttcccgcccgcgctagccggcgccgggcgcccagctctgtcgtcgcgcggatgctggggaacctgaagcgcggactctgacgcaggggcgccggggctgctccgcaggaacccagtccgggctgccctgaacaccagctcagctccgggctgcgcttcccaggagttggcaggggagggagtgcagggcagcggattcggcgcgcacactccacactctcgctcagaggcggcaaacagcgttggggtggggaaatccttcatccagcgcccactgcctactggcctgggctcaggcagctggcatgtgaaggcaccgtcgccggtgacacccaggctgcaagcgacccgggggtgctgggacagagtgggagcctcccagtagcccagcgtagcccgaggagcttgcgcccttctacctttcctccccggtacgtggctgtccccgccggatttcagacgcccgacgggcgccgagccaaaggccgtggtctccggcgtttcgagctgcgcccagcccagccgggctggttcgagaagggggtggccgcccgcagcgccaggtgggccgtgtgctcagagcaaactttagggtctaccgactcgaagcacccctgggaccccgatcctcagcgatggggaccataactgggggctacaagtgtaccccggaacccccagaacagtcagacttcctgcacccgccctcagccttaccgtgctgcagagctccggcggcggcgggggcagtgtccgaggggcgggcggccgccggcgcgggcagcctggactcaggcggccgccaaggaacccagccctgttgcagatcaccccctggctagcggccggtgcccccgcgcccgcccgccgccggccgcttcagctcgcggccaagttcatgctggcggcgctgcagtggcggcctcaatctgctcgctccattcccaccgcccggctccgcgccgcgcgcccggaaggtggagtttcgggggtttaagttactgataggcatttctcactgctgtgtcactcggggaggaggagacacgcacgccgcacactcacacaccctcacactcacggcgacgagcggctccggccttaaaggggaagccgcgctgccctgcccgcgaccccgccagcccgaagcctggaaactcagggtttccactccgggatggggcagcgggcagccaaagagctgcggccgcccgaggggcctcccgggccctcccaccagtctttagaggagaaagcggccgcaggctggcttcgctgttgcagcctcatttctccagtcggctcgaaccagggcagctggggagggatcggaggggcggaaggggcatcggtgcactcaccttggctgctccgcactcagtggagggtggtctgtgcccccggcgtcagctggcttgcctaggcggtgcgctggtggaaagaggcgacagcagggttagcggagcgcctccagcagacagagcccgccggagggccgcaggcggggcccggcgcgcttgggaaacccgcacgccgaaggtagactttccgcgtctggggaaaacgagctggtgagccgtgcgtggccgggacacacgaagagcgagcacggagagccaaaagccagcggtcatcagtgacagggcgagagagcgctcaggaccgagagaccaagaaagacaggagaccgtacgagacacagagaaggcagagactgagagacagataccgagagaggcaccggcggagatagaggtagagacacgatgaagggagaggagaggagaggagatgagaggagaggagaggagaggaggaaataaggagaggaggagagggaccagagaacaagagagcttgcaagaggaatgacagatccccagaggaccctgaagtgtcacagggacgggagtctcatcacaaagtagcctattcagcccccatcccccttcccattttcaccagagcctgaccctagggctagcggccaggcccttctcctcccctcgccctgggaggggcactcacctgcagtgggtggctgctgggtgggtagcgccagtccctccgcccacgcatccgctcaccagctcgcgccctgactgccaaacagacccgctgtggcggcagcggggaccagggctctcaggtggcagttagtgaactgcattctctccatcccggccgagtgccccactccccacttcccagtcccccacccttagcgcggacgctgtcggcgtcgcccgccagtacgcttagctcagagtccaggctcgctggccagtctcccgttccactggaccagggcacgcgatgctcccgcccaagctgggctggattggctccctccgcagttatcccaagacggacacctgcggcttctgcaggaacataggttccttgggaactgccgggcgggccagcgcgccctgtccaccatctgccctggcgccgagtccagcgactcccctcccacctatcccacctcccgggtatttggctgcgccccttctctaggatcccctccccggatgcgtttcctaacctggacttctccagccgatggcagctgcaggggctgagcacaacccgggaacgccgcgtctgctccgacagcagcagcgctcagctcctgtccgcacctctgagtagcaacctgtcaccaacacatctggtcacgctcagcggagccgcaggccacgaataaaggggtgggcccgccgcccactaggcccctccttccctccacgcccacgctctcggccctcggaaagcgctggggccacctccgagaacccagcaagatcccttcgtgggctacgtaggcgcagtgaggctgggcgattgcctcctagcgtttcacgaagttacctggagaaagagcggcgtccaggcccaaccgcgaggcacatgcaggggctgtggcttcgcagccccagcgctgccaggatgcgcccagcccaacagggcgaggctgggggtacacagttcgtcagggcagttgtgaaggaatccgccttgtctgggtccagtcccgtctgctctgcaaagggcaagcagccagaagaggttattgctctctggtgactgaaccttaccttcaaggccctccagggagagctagagtcatctcagggttgccagtgccccggtagaactgcgagagtgcgggagtcccttgaaggaaatctgattaaacaaagctgaatgggagatggccatgcctatcacggagcattggcaggatgcttttaaaattctatctgcaacctccaagtgcactagccaaggagatggaaggtgggtttccgttcccagcacctccactcaacccttggaccacttgctctcatcttcctcagtgggacaaatgatgcccattcccctagagcatcctaagaagcctgtaatatcacagccacacgtctgcgagatggctaactgcctgcttggcaccagcacctggatggccattagaaatcgcaaactccacataacctgactgaaccgagttcctgatcgtctcccaagtgtgccgagcccatagtctgctacctcagttcatggctactccatccttcacgttgcccaggcagaaggccctgggatcctccccgattcttctctcttgctcacacctcacagccagtccagtggacaattctgccatctgcatcatcaaaatgtatccacaatgtcagtctgctcatccattgctccccccgggtaccagccagcagcctctccccccaggataactccagtagctgccgcacagactgccctcattcctccctcccttcaaccctctccttgcagtctattccccgatctctgtgccaaaccccacagtgactccccattgcactcaaagtagaactgaagtgcttctagtggcctctggggcccttcaggcatgtccctccactatctcaataacgtcatcttccctccactcactgtgctccagccacacagacctcccaactcttcctcaacacatagatacattcctgctttacttaggacttttgctttagctgttcccttgggctggaattcacttccccaagatatctatgggctggctccctcatttcctttagtcttgacacaaatgtcacctggccaccctatgtaacatttcaaagccccacgcccatctctggcacttcctctctccttcccagctttgttttctctttagcgcttaccgctagctgacctcctctataggttagatcccaagagggtagcagtcagcgtctgttttgttcactgctgtcttcccagctcccagcacggtgcctggcatggagtatctgttcaatgaatgttagtagattctgctttcctggaacttttcaggaaactctgggggccactgcactgtacacacccactggaaaaggggcccatagatgtcatcacatttgaaggtggttcatgacctaaacaaaggttaagaaggctagagggcaggcaaagagctttgtgttaatgacatgaaaccagcttcgggtcatgtcaccaaggggcagtgtggcacacatgcattggtggcagtcttacaggcagtcacaaaggtacagagagtgattccttcagttactggtggaaagaggtttccttgtggttgtcacctagggtatcccaaggttgatggacaaatgggagaggaggccggagacagaggcagggtgagggctttctcttcactgagtagactggctctgagagccagggcccttttttcacccaaaatgcaagaccaagtctggagctcagcagcacatcttcctccattaacgtagaactagcctgtgctttacgtgcagggtccgtgtccccagtgaggtgttgatcattatctccatgttctaaatgaggaaatcagacactcagagaggtagaggcacatatccaggggcacacaacccatgagtggtagagcagtaaagcaattgggcctcaaagcttgggccatttccacttgctatgtggccacccatgtttagtgtgtgcagtcctggcctgtgggtccaggcaaggaaaagaataccatggggtttcaaggagctgtcctcctaggggaactcctggtccttttgctgagtggttgctaaacaaaaagctgggcttaggctattggggtccagagataccatgccggggctgatatgagccctgtctttgctctgacccaaacctggagctcaatggatttgaaaaatacaatcatcagccacctgtcatttatagtcatattcttgtgaacagatggcaagttttcccaagttcatctgacaaatactgggacttaactgggcagcctctggaattctgggtgtggcctgcgcaggtaggggcgcatggagaacacacatgttgactggaaagaggaaatacacatccagtgactctatttctcattactcccatgctcaaaagcctcctgcggctttctactgctgacagcactaaatcccaacatctcagcttgacatgcaaggcccttcatagtgagcaccagtctctgtttacttctagattcttctcttggtactttcacacatgcacctgggtctcctgcttggctggactgctgactggacacctaacaattcctggttcttcccacttctgcccctttgctcatatattccccatgccagctctcctttcaaaatcttgcctgggttgagcacagtgtatcacgcctgcaatcccagcactttgggaagccaaagagggagaatcgtctgagcccaggagttcgaggcaagcctgggcaagaaagtgagatcccatctctatatatataaaaaaaatcctgcctggccttcaaggctcatctcaaaggccttctcctcaatgaagcttgtcctgagtcccatcacagcacaggtgccctccctcctttggacatcctcagccctagctgtccttttctgacaccgtaggcctttgtcctcagctcttccttgtttcacagtttaacagtgctttttggggtttccccaaagcctccctgatggacccatggctaatcctcagctgcagtgggtgtgtgtgttggggggtgttcagggtaccctctggatggcagaatatgaatccagagagagaaagtgagatgatggatgtggccagcaccttctggcatcccccacttcacctctaatgctcagaggccattagccaatgcccaactggaggccaccacgtccacctgctcccttggctcccagccccctacacccatgcctcactcagccaggcagatgccacaccccaggccctcagcaaagccagagacccccacccccaggctcttgagctctaggctcctggggcattggctcagggcttgtggactcctcatctgcacagagtcctagccccagggaacctgagttctctgaccacagcttgctggaagccacaaccaacaggaacacaggaatgaggacggacaagtgcccttgggaaggccttgggtgacgactaccccatgcagaggaagtgcagtgaacttgatctgggaggcaaaaggcactggtgtacacccagattctgctgtctcccagctgtacaacctcctgagcctcacaggtctcatttccaaaatggagtcacagtagtaacggccttattggtgtgtagtcagggttttagttctgtcatggacaggaccaccctagtcaaggtgtctaccccatgagtcattagccctcagagaagaggatgctatcgtgattgttatcctacataccctaaaagacaagaggcagccagccttgaacctaatcaaatgaaaagtattcggacaaaagctcaggtcttgcatgtacgttcaaaacatcttgtgatattgaacactctgcaagtgcttgatatgtctggcaaaaaaaaagatgagcctgtgccaggtaaggaaacagattggggcactcacagaggacacatcggcattttgccccggtggggcagaggagagccactgggaaacaagttgacttatttctttttgctgtgttcttgaacaattttaatattcttggggatgttgaagaaacacaatagaaacaaatgggaaatggttaaaatattgattgtaatttcctggcgacttcactgatttaaaatacaggaacctttaagaaaaaaaaaaagccctcattagcaagcaagcagttaattaagggcctgtagaatggtttgcatcgatttcaccatgaaaccagaaaactgtggctacaagtcaatttttccctccgtagctgcttacttaccatgaacgctgtttccaaaatgccataggtaatgctaccaaagcctagataaggatgggatatggtcatttaaacagagatggataaacagtttagggaattaatgtaaatccagatggctgccagtttcccacttgcaccatgcataggactgaaagacattgtcaaagctcttatatagaaaaaagtatgcagatggcatgctaattattactcttcatgcaatgacattattttccaagagaaaaggcccaactcaggacccacatgggaagaggttctacccactgttctaggacgcttcagatcatttgcaattttgtgacttaaaaagcgaaaacaacacaactctggcctatgcctgtcctagcaaccatctaggctgctgctgcaccatcactacaatcattctcaaggttaatatgacctaactccaggaaaccagctgggcccaccgtcaggcaggcacactctccaggacgtctggagaaaaccagacaatgtgctccaggtgacctgtgtttggaaagcacaatcatataagcaataaaagcagctaaagcttgagggcacacctattatgtggcaggccctgtgcttaacatctacgagctcaatgaagccttgtaaaaacacatttcagggctaagcgaactgaggctcagagaggttaagcaatttttctgagatcacacagttactccctgtggaaccaagatttggatgtcctaggcagtctggaactgagtggcctcaagagtatcctattaacataaagctcagcagggaggagggaagtaacatgtacttcacacatggctagttctgtgcctggtgcttcgctagctggcttgcatcaccttgtgagaaaggatggttacattttcagaaatcttgtcaacctgttgatgacacattggtagcctgaaattggcaatagtgggaataggcacaccaccaaaatgggcaaatgctacaaatcagggctggttgttaaatatttaccaacataccactgcaccacaggtgtcagagtcagacggcctggttcaactcctggcctcagcacttactgggtggcctggggcaagtttcctaatttgtgaaatggagataacaatagtgcccacctcatcaggttgttgcaatcattaattaatccatgtaaattacctggcacagcataagtaatcaattcacattagttgtaaacataactatactgcaactactactactactacttattattattatcatcttcattattatatttaggcagccattcactttcatctagagtacagcaaccatgtcctaactagtctcctttcttccagtcttgtcctctccaatacattctcctgacagccactagcgtaaatttcccatatacagatccttccttgcttaaactatttccttggctccctctaaccctgagggctaaagtcccacctcctttgcttaggatatgtggtctacctgacctgcccctactccaaaataccaaaatctgtcatagtttgttagggctgccataaaaaagtgccacaacctagggggcttaaacgacagacatttcttgtctcacagttctagaggccagaagtctgaaatcaaggtgtgtcagtggggtttcttctgagagctgtgagggaaggatctgtcttaggcctttctccttggctttagatggccatcttctccttgtgtctcttcacagtcttcctttaatgcatacttctatgtccaaatttctctctttcataaagaacacctgtcatattgaattagggccccatcctactccagtataaccacatcttaactaatttcatctgcaatgaccctatttccaaataagatcacattttgagatactggaggttgagacttcaacatacaacttcaacttggtacttctaaatactggaggttgggacttcaacatatgaatttggtgggaggacacaattcagccagtaacagtctgccctctggcccccaaaagtgcacatttttctcatgcaaaagacagtcactccatctccacaccccctaaagccttagcccattccagcaccaactctcagtccataatcttatctaaacatcatttaaattagatatgggtgagactgggggtataactcatcttggagcaatgtttctctccatctgtgtacctgtgaaaccaggcaacatgttctctgcttccaaaatgtcatggtgggacaggcataagacagacattcccattccaagaaggaggaattggaggggaaaaaggactcatggatcctgagaaagtctgaaaactagcagcacaaattccatttgattcatttgattttaaggcttgaggataatcctctttggcttgatgctctgtcctctgggtttgcccccgagcctctacaaaggtagctcatgtggtggacagagcaaacaagtcattgttctgaaaaacactgttctttcacacctccatgctgtgtacccgttgttcccttcaggcagcaggaggccctcctttcccctggtcagttggggtactcctctgaagtcattaggcctcagctgaagcctaaggtccttgtttgtgaggccctctttgactccctcctccctgaggcccaggaaacggagctgccccatttgtgaaaagcacctctagcatctgagctgactctattgcagccgttactaccttggcttgtaactgttgatttacccgttttctcggtagactatgaactacttgatattaagcacaagttctcatttttgtcatgtctttgcaaaatgggattgggcacagagctggtgtgcaatatacaaatgcctgtttctgtgatagcaaatgcacagaggagctttttctgaatacctactgtgtgcagagcattggacttgggctgtacactcttggaaagagcagacacaaggacaaactctctcacattcatcattagagacaacatatgtaccatacttgagagctggaagggccttagcagcaggtgctgacacctgacttattaactcattgattggatcattacaccaactctgtgagatataacatagggtagtgtaaaggcaagcaatcaggagccagcctgctttgaatccaggctttgcctcttaccagctctgtgaccttgggcagcttacttaaccccctctgtgtttttggtttccttatctgtaaaatgggactagcagtggcacttacctcacagggtggcatgaggattcagtcagttaacatctttcagatgttagctattattcagatatagccagggtctaataggtatcctagaacctgctgctgctcctgctgaaaaatgcttgctgagagcaaaacatgcttaactgctgagcgtcagggctgggcaaaataagtcctaagggcccctccagttctcctgtgaagtgctgctgtcctctatgtgaaataactcagtgcaccaacaagcaacaggtaagtacaaataaatatgtgcatgtgggaggagagtaggcccctaaagagctagtgatgcaccatgtcaggtggtggcagccccatgaacaagattctgggttattggccccatcctgcaagtggcccactgtaggacctgggacaagctcttttccctttctgggcttgagtttctggctctctcacaagcttggacctcccatttctagcattttccagggagctcccctcacctgccctggtagccaggagaccagtcctggtagccaggagaccaatcctggactgtgggtggtcgccagttgtgttggcactatagctatacccccagtaccctgcctcacagccccatagcatatctgccagcaaggaaaccctgctcccttaaggactgagtgtagatgccactcagtgaaattagagtaacaaaaccaaaggaaggaaggcaaggaagtagcttgctgcttttctctgtaagctagggtgtttgtctctcaggccctttctcctgaactaggaagcaggtgaggctagggatgctttcctccctgagtgcattctgcctgggtacttcattaagcccttaatgcctcagggcatgggatgtagagtggccctcttgctcctgggatgctgctcaaggcacttccaaggtggtactatatggggaattacggtattgggcagttgccaggaggaagagagtgtgtgccttacaaggaactgaaatgtccctgctgttcagagaaaggagattcacagaataaggcaaaatcgatgccttttgcagcagccaaatttccatctcattgctgtgtgctggagacgtgatgcccagagctggatcacacaggctggtgtcacgttgcatcagtggcaaaacaaacggctttagtaataaaatcccctggacctagtggcagatgccttgctggctaggagggccatggtgcctggctttagaaccgtggaggtccaagaaagatagacatggtgtcacactgacccttgcagtggacatctagaagcttcctataggtagccatgcagtgctcaacatccttcctgtctgtagccctgccccacagaagccatccttcccagaacacgtcattgcccatgtcattgccctggtctatctgtgaaaccacagtcccacactggcttcacattcctgaagagtgaatgtggcagtgtgccaccctataggctccactctaccatgccactccataggcccagtgactctaggagaatcagagaagaagactcaagaagcttttgcaacccttagcagaggctgagaaaatcagagcagaagcctcgagaagcttctgtaaccctaaagcagctgagaacaccaggggccacgtttttctatagtagggtaaacggcaagcagaacatttcctacccttgatggaggccagaactagctgtcccctgtcaaactccatgccaactcctgctctccgctcagggcttgttcctgctaatgaaatggctattctgccagtgtaacattacttagcgatttattagtgattattgattttcaattgtggtttccaggggctgagggatggagcaaatcgaaggcatcctgcctgtagatctacatccatttgcttgaggccatgggctcagatgcaagtagctcatccattgctgaaaacaccaggagaggaaaccatcactacttcctgctcctaagtttccactcactgttccctgaaaagccctccatcccacttcccccaaagccccagctgcagatgggagcacacagggttttaagtggatgcttttatgattttttataaatggccctgactggatcctgttcccacctcccaggactcaccctgcctctttgctccctggaggcctctctccttttatctctcttaaaggattcccatttcttcctaatggtccattgtccctcagcatggaaaatggtgacctccctaccctggcaggaagcaggaacttttgggccagttttctgtattatcttgtggccttgggccttctttaccaccatgctcctgggcctggaaggaatcttaaagtgaggttgttcaatcttttcccagccctgtctgtgactcccagatccagcctccaatgtgagaaagaatgggcactcatacattctctcctaagtgtcccctgagaaccttcctccagcaccatactggttgcagaagaaagagctatacaaaaaaaaggaaggtctaccagaaacctcttatatattttatgacatctgcttagtcttgtctgtctcttattcctgccacctctgaagcacccacttctttctgtgtggtctccaacaaatttcatgcaggtacagtttgatagcacgtcccttcaggcttacaccccatgcctctacctgaccttcttttttgacattggcatagaatgtcagggaaacttgctttgcatgtgtacacagaggggagttaagattctatggagtgaaactttggccaatgaggaaaggaggtgatggataactgattcccttattttcccccagttctgagacacagttcatttggcttctcagagggttatatgccatcaagcaatcagtcacaaattatggtgggcaattagatataatatccttgttttggctcttcttcctttcctatttcccatctcatcccttactcttgttcttgggatcacatttcccaataaaggtactcacataaaagctgatgtcttaggctctgctttccagggaaccagatagttgctagtaggaagggttttaccaatcctaaggatggaattatagaactggacctcttaccagtaagatgagaataagaaccccatttccggtgaaaagagggggctgtggtgagccctggcatgcagtggcatcacagttatttgctttcacctgtgaaacatgtggttatgtggtaactgtgacccttgactagcacggggacaatggtgattgtaaggatttgagagttgcttggcttttgttactttgggaagtttgcagtaaagaaaatgacaggcttgggtcagccaaccattaatttaaaacactctgtgaaagctagagggcctctatggatgtatataaaaggatccttatctcctgccgtggcagggcaggccatgctgaaaatcagacccaacaccaaattgtaagattagcatgccacaaagaagattgaatggcagcctcaatagtttcctatatcaaggccctgacagaaaaacagtgggaccttgacacctaggatgtaaatatttggatagataactgtgagaacttgaactcccatattttccagaagcctccatgctggtagccattttctttttgtcagagaaaagcagcttgttcttgtgtggagatcctgtgatgatgtcacctgatgcaggtgtcttacaatacaatgcttttcctcctcaagacctgactccactgtcttttattgcctccaggctgatatctgtggcaccagagaccatcagtttcttcattaaccctcttgaattaggtctttgcaaaaattgcagttggccaccaccttgaaggggcctctgagacagattgatctgggttctcacctgtctcaaggaagaagtgagagcattttgtttcccaaaacatggaggctccatattgcaacatgggagctgagtataatggaagatacaagcaaacctgagtggtacaagggatggactgtatcaaacaccatttatgtcccactttaagtcctcttggcctcacttgacccttagttcagccactgctgtgacaactggttctgtgaagattctgaacacctccatgccaatgcaacctgccagtgccttgcaatgcctgcttctcctctccttcccttgggcatctctgatgccagcatgggaactctcacagcacccacttatgtgtaccttggcatttgggggcttttacatcccataagatgactgcctctctttttcttcccccatggatgatcccaagatgcatttcatatggtttcttaggtagccctggaaattcaagcagccagttgcctttcatggagggcaacttgataacacatgcttatattggctttttatcctatgcattgctcccctgcctctcacttctgctttctggagtcatcttcctcccaaaacattcacacataagcctttgtcttcaattctactctctgaggagtgcaggctatgagagtaggcacatgcctaccctcactgagtttccagtctggttggggaaacaaacacagggtatttataaacctggtataacgtgtaccatacaggactgtgcccagtgcagcaggagtgaaggagatcataggaaccctaagtaatctggacggagggttcccttaagttgtgatagttttgctgatacgtgaagcataggtagaaggttagtcaggagaaaggagtgtggaccagtgtttttgtggggcaggtatttttacagggtggagagaagaaggggatgcaccaaaaattgctggatgcttcagcgttggaagcaggggttggggtggtttgagggtacatgggaagtggaggcagccagagcaggcagaatggggtccaggaccagaggaagagatcagccttccacagaggaaggagtaatccttcttcttttgagattgaagtggaagaagaaagagggaagggaggtgtgtgggcattttgaggtggggaggacgctgaaagcctcttctctgcaaagcctgagctaagcctgttgctggcagagtaagggtggggctgaggctggaggaggcttgtggggaaggcacaggacagctgctaggcggggggtggggaattccagagcgattgagttggctgagtgagctctgtctgccctacctgcctgcaggctttgcatagaggagagcctggggcactttgttgaaaggagagctggtttgctaatcgcacctgaattgctgtgagttcacacttaccctccacttgacccacacttgtctttccttcttactgccttctccactctctcaaatgaacccactttcccatccccaaacctttagccccctctgcaaggaacaactggttttagattcccccaagccacaacccacattcttcaaatcacaactcaaagccccacctcgaagaaactatctttgtgtttaataccgaccattctcaaacccctcagcagaagccccaaacttgccctcttgtcgaatgcgctcctataattgcttttgccttctgaatttagccaggtctgggagacaactagtgcctgtctcatggcccagtgagaatggcagctctgaagggcagggagggactgagcccaccttccactcctgcccctgcttgcgctagacgagtaggaagtctccagacatttttggcactcaaagggggtcagaggtaagcccctcccaggagtccgaagaccattccagggattcttgagtcaagcttggatgcccgctcctaggaagcccatggaggcttcaatttatctatgagacctttggatttgggtgcagaatattgtatgtgcatatgtatgcatgtgtgcagatgcacttctgtgtatttttctgggtagaagttccttaacatttatctgctttttaaaatacatctataatcttcaaataacccagatcctctgctgcctttcttggtggacagcagcctgcagttggcctacactctctattctgggtgcagtactgggaggaatcactgcagagctcatctgccgtcagagtgtcaaattcagacattcaaatggttgctacaccaaagtccctgggctactggcaagggtgttgtggctatttgtactcagccagaatccagtctgtgagccacagcatccctcaacatcccagtgaatggatgacaattaagagccatccacgtttatgaatcttgtggaaattaataaacctgttggttctggaaggccttttaaagtccatcgagttcagtatttccagaaatgtgttatatggaacatgagttttgccagatgtggaaaaaagatactaagaaaaaagatttagagatcaaaaataacttgggagctttagggctaaacaacactaagtagttctctttctagtgggacttatcggagcctttattatgttatatgctttgaattttcaggaagaagataaaatgaacagtgtttcccaactctatttcaagagctacgaaattcattcacagagtatctgggcagaagcagagttccaaagagtgctctaatccacaggtctaatttgaccccctccttttacaaaggaaaaaatgaagccccagagaagtaaaaggtcttgcagcccaaggtcatttacaaaactattcagttattaaaggcagctgtaaggttgttggctggggtggggtggggtgggaggatgcagaccaaggaacaaataggctgccttagttggtagtgagttccctgtgcagctctggaggattgaatgagggccaagtatccctcagcaagggtgttgtctaggatcttgctaccaaaacggtggtccagggaccagccatgtcaccattccctgtgagctcatcagaatctcgaaatctcaggctcctcccctgacctatcaactcagaatatgcactcgaacaagctcgccaggggattcggcggtatattcaagtaagatgagggggccctgtgggtcacttatttgtagtcttctgttggccagatttggattggaaatcatttcctgagattcaggaagttctcttcaccccccacctaagcagcgaactctctggatacatgagcacccttggggataagtggagagtgggggcactaccactctttcctaactccctgccctgcccaaactgctaggctagagcctagaccaggtgacacataaacctgaccatcacactcattttggccttacaaaaattctacaattagctccattttgcttttgaggaaactgaggggcccagagaataagtaacacacccaagagcagccaggcagtcagtgacagaggcagggtctgaacacagggagcctaacttcagattccattagagtctccactgcctctcagagcagcctgcccacagtgtcacaggtctcagggtggcagctcactggctcctaggtctggctttggagctggtacatactccgaccactgacaggagatgttcacacaaagacagcagaagcttggcacctgtctgggccaggcttgcagggctttatttgcctgtggttttgaaaatgtctctgggttgtattttctgggcatgtgtgctcaggcctgcaggggtaggggatgcccactcgtagcctggttatgagatagagccttgatatccttgtgcttccagcacagcccatgagccatcccaaagtctaaaactccaagcttatgtcccagtgcatgcccagctcagaccccaagccaggaccatgggctataaatttcccatatgggcaaattcccatatgggcatgcttctgtgaaatgtccagaagtgccttccatgctggccgtagggctatactgcaggccctgtattctgatgggggtctgagctcagatgaagctgaaatgggggctgatgatatggcagtccttttggttggacctgacatggaaatctcaggagaggcctgccctgcccccctctctagcctcagtgttcccatctttatgatgagagggaaagaatagaatgatctttagggtgctcttcatcttaaaactggtcttaaaacagcagagttcgaaggtacagccctcctttttctagggcaccaagaaagacattccagagggcttggctggggactctttttctggaattgggtgttgggagtcagttactgacagctaatagttaggcattgcttgttttcacacttgtgtaaaacaaacaaacaaacacgaaaaacttctagtagaacacagcattctaaaggcaagagatggtgatcttgagacaaatcttggggggaattaagacatttagaagatgcagtctctaagattcccttcctcggctgggcgtggtggctcacgcctgcaatcccagcactttgggaggccaaggcgggcggatcacgaggtcaggagatcgagaccatcctggttaacacggtgaaaccctgtctctactaaaaatacaaaaaattagccgcgtgtggtggcaggcgcctgtagtcccagctacttgggaggctgaggcaggagaatggcatgaacctgggaggcagagcttgcagtgagccaagatcgcgccactgcactccagcctgggagacagagagagtccgtctcaaaaaaaaaaaaaagattcccttcctctctcccttcttccctccttcgttccctcccttcgttcctccttccttccttccttctttcagtttttctgtctccctctctctctccctctcttccttacttgctgtctgttatcttaccccaggcacaggtcagctcaaacagctgagcaaggacaggcatgctgtcttggcccatctggggagggactgaacggcagcattcttctcctgcctcctcctcacatttaacacacaccctcccattattctaaaagaaaaatgccaagattccaggaagcagtacaaatgtgtgttgaccttggagccctagatccatagtggcagcttgtcctcaaagcatacaactgtagacgggggtgcgacaggcttcagcctctccttccttctgggccccactgtggctcactcttggacctgaacgctgatcacagggaatgcaggtaactcccctgaagacagcactgaccaacactaagtttagaagtaagagctggcctggccaaggcactctgagtaggctgtctctgcttggctgtctcaagaagaagagcctaggagcctgacttcttgatcctgcctttggtccactatgcttccataagagggctcccttgggtgtgcacagttctttgcaaattaccaaacatgttcctgttccttcctttcatgtattcatctgttgattctcttgtttgctgcatatttatcaaatgctgattgtgtgtatttggcattggaggtggaacagtgactgagatcaagcttattgctgcccttctgatatttgccattttacagggaagtgagacaaggaacaaagaattccaagagaggtacatatttcaaagactttgagactctactgtagcccaaaaaggcagtgaagagtgccatgctcaagactaagtggggtggggttgtttgatctcaggtgtcctacctcccagctcagggctttctccacctctcttcactgccctccccttatttttccacctacccccagctgctgccaattgcactgtcattcactgtcattcattcaatgagcttggccaatgataagatcctgtgctgacttcctgttgccaaaccaggggacaaaactgaagctcttggcaatcttgagagaaggccaagccatggataactacaacagcttatcaaccttccttagcctcccactctagctggcaaagtcgggctccaccctgaggctcctgacacctggggtgaggccaggttaaagggacctgaaggtggagtgctgtaagctggggctggggagggaattacctgccttgaagaggaaagctgtgggtataactgtgtttaggatgtagagggaaccaatcaactttggacccctcctgtgtgcaataagcctgcattttataggtaagaaaactgatgcttagaatgggtagaaatgtgacttacccaatatcacttgatttcacagggttttgaagggagagggacctgacattgactgttcctagcataagggagtccagaatgcaacaaagagggtcagaaaagagcaagaacaaggctgcctgggggctgggtggccttccggccttgagttagggagttgtgtattgagggattcactggacggtactccaggtgtgaaggccagcgctgctatgcctgtagaggtcaaaggtgatatgccacacctatgtcctcttttcttgctttgtccttgctttacattctccttaggcatttctgtacggtagtcaaggcccttcaagagtcagccttgcctccatccagctctgctaagcatttgcccgattgtctcaagtaatccccactcgtgcattgtgtgggatgttcagtgggcagtctcactttacaatagcaaacttggaggctgagaatggaacccacatgcctgaggccacctagctcccagccatgttctcaagtctctctgccctgtgttgagttgtccatacctgtgccttagctcacagcagctgagccatattccttggaattgacgaaagaatctataactctggacagctctttcacactagagcactggctcccttagctgctacgtggactccattctttcaggagctccaccaggggcaggaagccctgactccagccccgtgactagacccatcagcctctttcccccttagagtggggctaacaggcagttcttagaccctggcactgaggcctaacttagctgtgacaaaccagtgatttccgaccaggagaccagtccctacaggaagtgatgaccaattgtcattacccagaaaatctcagcagctccaccatgaattgtccggaccattccagggctaaatttggcaggggaggaatcctaggaattctttaggctctcagattccactttcttattttggggtctagggaagaaggggtggactctgtgaaactgtatcctcagccccagctctggagctgagggagaggcagtgcttggagccccagggagtggcagtcccctcccccaaccccactccctcctctggcaccagggtcaccagggccacatggtagtttctggtttcaccaaactcttctcaatccctggagctctatgctgggggcttctgggcttccctggggggcttttctgaggacctctagccacttgcccttagtggggactggggggaccctgacaggtcagactctgctgatgtgtcctcattctctggctccattctagtcttgtggaggtgtcactctccaaggcccaccctcagccccagcagacctctgcctccccagtggctcccgctcctcttggccctctatggcagtgatgacaatgatggccctccatggcatctgaagcaatggcgagctcggcggcggggaggggacagcctggactgcatgctgtgtctctgcagtgcatccccactgtgctggggacacagaaccacccacatctgtgctgtggcagggcagggttctgcccccagagcccagggtcatatcagtcccttgtatgtcttagccaggccagggacgtgcctatgggtctgtgactgatctctcacctgttctctttagagagtggccccacaagaggagcagctgagaaaggcaccagcctgcaaatggcagagccctccagcttgtgggcaggaggccactccttcgaagggctatgggagacaggtagacattcaggcaggagtcccaaaggaactcagagcccaggccccatccctgcatctccctgacagcctgggaaggaggaagggagggagaaacagacggaaagagggagggagagaaggagggagagagggatggaaagaaagggaaagagagggaggggggagggagggagggggagggaaggggaaggagggaaggaggtccatggttcccctgagcatccactgggaaagccccatcagccaccactggggccgaggccgctgtttctgagatgtgtcttgtgctcccggggacagtgtgcacccatggggcagatgccaccttcaccaggtgaatttgcagaaggactcagagtcacccaaaccaggtgggacattttcccactctgaccccagcattatactggttccttctgaggatcttggacggggctactgggtcctccagagcccagggcacctggggaggccctgctgagagccccagctgaggactcagggaccgcccccgccccggggccttgacttgcaagggacctcgggcacagccctgcctcctgtgggcctggatctccccacctgtcagcactttgtgctgggggcctgcctgacccgagaggccctgcctgtctttcccacaggctcccagagactgaccggcttaaggctcgaggcgtgccagggcccccggagtcaccctgcatcagctcttgccgcctgctgcctgggcacgggagaccacactggtggaggggatgagacagggcaggcccagccttgggacacccctgtccccacagctccagtgactgggtgcttcccccagccctgcagagcagcctgccccactgcagacagtgctggtccagggaggtcctcacaggacaaccagagttgtgatgcgggtgatgatcagaagctgtgagtgtggaggaggcaggttctctctgtctagccattgtacagatgaggaaacggtggcccaacgccacacagtgcccagcaggggtggccccaggagccagtattccagttcaggcttgactgacctcataacccccaaactggctcatgctgcctcccggctatgctctaagatccccaaaggggaggccctcactagacccccatcctgtccaatgcccagcactgtgccaggcagaaaagtgacaaacagttggcatctcttaaagggtggtccagccgaaggagctgcccacccagctagagagggagcagcaccctgtccaggcctgtcctgacgaatggggcctgtatgagggaggcctgtctctgcaaaaaggctgtcctttgccagccctgcacaccctcccactcaaacctgttgctctcggcagcagtggctgacttgagacttggtgttctctgttctttcagggcaaataaagctgacgtgttggcctccagctctgtgagggagggaagaggtaccttgggctcccagctcctgcccacacacagtagacctgggggctgggtttcctccccagaggaacactggtccccactgaaccacacgtgaaaccttggcattgttgactatattaaggcagagggatagggcagtttgggtcgggtgggagaggagctggggagatagggagaagtgttcgtgggggtggggtggggagaggtggagaggggtgccttccatgtcttctaaggaattacacttctagaaagaagcataagttacaatcaatttccagataatacatgccttgaaagacagattggtggcttgcatgttcattgtacccaaactttaattaaaccttttaaaacgaaaaccagcccttgcattattctgctaattgaccggacctgttgaaagaaggccctgtctggggctgcagtgattgtgtgctaataaaatttatttctgcaggctcacccaattccctattatgtattcaagaactgtgtgggctccaagccagtcatcacaaagcaaaaagtaataaaacctccaaagattcctcctccctgcccctggcctgccattcctggtcatgctctgtcttggcctggctcttgtgccatgagttcagttgggaccatctgaggttttgccctttttcagcagtggggatttggaagtgcctgcgtttatttaagtgggcactttgaaggctccccaagttcataggacacgaggctggtgatgagcagagatgttacttcccagtgctggcagcatggcacatagaggtgggagtgacagccatagcctcattcttttcaattccattcagagaaatcaggggctatagccagctcggctccttagcctcatctccttggcaggctgcagtgccctgagctgccatggtgcttctcagggtcttggacttggcttccatctgctgctcacatgtctgcaggaaaggaagagcctggagcctctacttccctgggacagggtggggcgtcttatgccacacaggggaatggctgaacccagctctgtgactgctctgctgagagaccctggttagatgctgtccctctaggctttggtgtccctatcggtctggagaaggggcagccagtctttgggtctgtgatcactccaatgcttatggaggcttcccagtgtcaagagaagcaggcctcctggctatggtggggaggggctctgtttgggaggacacagagctttgcacctcctctgtgacctgtgctgcttgccaggggtggaggaagatgggaactgaccttgatggagagagaaactgcagcacgatgtttcctgactgtccttgcctcctatggtgcaatcttgtcagaaattcgtcaccagtgaaaagacctagccagatgttccccctgggcactgcccttgaatcttcatgagacaatagtaggcactctttcagtcactcgacaaacaggtgctgggtacaacagaatgaaccagcgccgggttctcacttggtagctgtggagacaggcgtacctaaagtaccacctggcaagagctgtaaaagtgctgcatgcaagacactgtgggagcccaggcaagggagtgagtgactaagcctcctggggtgcaagctgccaggcttcctggggagtaggtgttggaactgggctttaaaggagtaatagggatcttccgggggagaagcagagagaacgatggaagcatatggaagcttcgagtgggctctgggatcaggctctgaggtcatggtgctgccctggctgtgaaggtagccagggacgtctggccttgttcatgttctcaatgctgatacccacactgagagaggtgattgcagggttgtgatggagactggccaagtccagagatccaagtgcttagatctggagaaggcagaagataacctcattcaggaaatccagaggggacgatggtggcagcagcatggtagagctgctgattgtttgacacacacacgcgcgcacacacacacgggcactgccatgaactaaatgtgtccacctcaaaattcatgttaaagccctgaccccaatgtgattgtatttggaggtggggcccttgggagataattaaagttaggtaaggccatgaggatggggacccacaatggaatagtgtccttataagaaaaggaagcgagactagagctcactgtctccttctgccgtgtgaggacacagtgaaaaggcagctgtctgcaagacagaacgagacctctcaccaggaactgaatctgctggcaccttgatcttggacttcccagcttccagaattgtgaggaataaatgtgttgtttcagccacccagtctatggtacgttgttatagcagccaagccgactgagacaggcaatgtgcagacacacatggagacacatacacacatgcacacacatatgcgtatgtacacacatgcacacataccaacagacaggcatacacacacacacacacacacacacacacacacacacacacatattcatttgtcaacacacagacgtgcccaaagccagaagcatgcccaggggcacactcacacataaatgcacatgcccacaaatgaatgcacacagcatatgaacattgagccccactttccacagcaccccaggcctctctgctcctggcaaacagtcaaaagcctccactccatgaacggaagcaaagtctagaacagatgcttagtgtcctattcactgcacaggctgagactctgagtggccctttcagaaaggcatggaaaatcctgtccggggactcctagatgggacagccgttcctgatgaggatggatcaaaatctgtactttcatttctgcttgtgcttccccacccccactgccacgagcccgggagtgccggcaaaggggcacaatatgggggcagaggaggcagctactgcaatcctggggaaaagggagggtaggcagccttgaatctgcccgtgtgtggggtgggggaggggaggtacatatgagagtgtgtgtgtgcatgtgtacgcgtgtgaatgtacacgtgcgagtgtgtgcacacacatgtgtatttgtgtgtgagtgaactgcaggtggcaacccttgctgtgcccctttggcagtgctgagccactgccacctgcatgtcaccagggcccatgctaaggtggggatgacaggctgtgagcagcccagggagagtaatgatgtgctggggcctcagagcctgtgagaggggctggggtcagggcagactcagggtggtagccagcaggcagccttctttctcccagatcaagttccgtgcacttcctctgcatggggtagtcgccagcctgagcctccccaagggcacttgtctgtcctcattcctgtgttcctgttggttgtggcctctagcatgctgtggtcagagaactcaggttctcttgatctaggaggcaaaaagccctggtgtacacccaggttctgctgcctgtcagctgtacaacctcctgaaccacacaggtctcatttacaaaatgagtgtcaatgggaagcacaacttgctctaggatggtggaagcctgggatgcatgctagttcctgtggctttgggcaagtccattcctctctctgggccagtttcgccatcctgataactttttaaaacgaaacagataaaccagttgctactctttttaaacggggtgggggatagtgaattttgagggtcaggaggcatctatttagtgtcttcaagttcattccacaacatgaaattggcacagatgtaccaagtgctgactctgtccattctctgtgctgaggtggtatggaggtgagcattaagcagtgaacaagactagtttgtgtccttgcattcaggggctgacagtctagccagggagctggaatagacagagccaaacacaataggtggcctctaagggctcttctggctctgagccccctgagtttgctccaaactggcctgatcaggaataggaaccctagagagaggagagaagatgtggttggtagaacaatgcctctccccacaccccagagcctgggagtatgttaccttccaaggcaaaggggactctgcaggtagaattaaatcaagactcttgacatggcgagatcatcctggattatccggatgagtcctaatgtaatcatgagaggggcacagtagggtcagtgtcagtagcaggagatgtgaggatggaagcaagagagtggagtgatttgaggaaaggccacaagccaaggaacacaggtggcctctagaagctggaaaaggcgaggaaacagattctcccttagagccttcagaaggaacacagcctgctggtgccctgattttagcccagtgtgacccatttcagacttctgatatccagagcagtaagagcataaatgtgtgttgttttaagccaccaagttggaggtaatttgttacagcagccctaggaaaccgatccagaaaggaattggctcttaagctcttactgtatgccaggcattgtgctctggggttgccactgattgtctcccttgattcatagaacagtctccatggttttggaaagctcttactataatgcctattttacagacgaggattatgcctatgttcacccagaggagatgtgatagcacaaggactggcttcaggcctgctggactctgggctgtgtgctccccaactgctgctgaagggatggaatttcccagattggagggcagattcctctgcagccattcagtgctggggaaggaaggtgctattctagatcaggctggactcaccttccatcactgacttaccttccatcactgacttccatcactgactcccctgggccagcctgggtgtcagcatcttccagtggcctgcagctccagcagtgatgctttttctagcacccctgcctgggcattgatccccaaattttggccagaatgcctctggggcagtgagctcacagaacacatggaactgctgtggctaaacagcctctctgtcccatcatattccttgaaacccagggagtttgcaacatctgtgtcccaaggccccagcagacctggacactaagactcagaaaaggatagggctttcgcccaaggtcacctaactgggtcaatgtcagattaaggtggggcctgcagctcttgcttagcagcagctggctctccctgttggctgggattgttggccctgatttatgagtcgaacagccaaagagacctgattcaatagcaggcacaagcaacacacaattagcctgctggcatggcagcaagtgtggcaaagtgaatttcttcactggcccctgaaagacctgtttgaataacacaaagtgttaacacaagtcttatttcccagctactcagattagcactgacaattgccagcctgtgacaagggcagtggctgagaggcacctcagttcacatggatggccacgtcatctttgccttcgcatgatacccccacagggaaaccagccacagcaggagagggagccatgtgcttccatctcacccaacttgcatctgggaggagaaggccaggggtgggttgggagacagatgcttccacatctgtaccctgtcctttcttcttgctgccaggacctccttttgggcaatgccacaggtgtaattctagcacctttcagaacactaactcaagaagatgggtgtggtccccttttccaagctctggctcattgggaagcccacaggcactcccagggcagctggggccttcctgggggattctaactgcaggagagtcctggtgttgtaggaagtagttttaccaccactacctcccatccagggtcctagctttatcctctggagcctctcaacaaccttgccctccagcagaccccagaaggtcagagcgggggtccctgctctcagcgagaactcaaggtctagtggagaagagatgggggagctggggctccccaaggagccatgtgtcccaaggaatcatgagttaggacttcaaggccctcaactgtcacccaaaactctgtgaggcaggtcttgttatcccatttcacaagtgatgacagactgagggcagcttgcccagtgttgctcagttggaaaggagctgaccagagatggaagcccaaagtgggtgtgtcaagaccagtgccaggttgccatcctctgagggacctattatcactgaaccacactttgggatttctcattgacttgcattctcatttgggagccaccatattttcatttctgattgatcttcaatacattttctctactccaaagtacttaatggtctataaatacattcttaaatgcacctgggagctgtttagtcagtgcaatcttttttattattcttataccatggttctcaaagtacggttcacaaaccagtagtattagtatcacctagagcatcttagaaattcaaattctcaggccctgcctccagattattgaagcagagattctgggtatagggcccagccaagactgactaccataacttgtggggctcacagcaaaatgaaaatgcagtctgttgttcaaaaattattaagcatttcaagatggtgacagcaaagcatcaaaccaagcatggggcccatctgagcaagggccctgtgtgactgcatggggtgcacactcatgaagccaggcttctgtccatcaactgtgtttttacaaccactccacgtgattccgtgcccactcaagtgtgaaaactacttcattaactctttttcattttaaaagtaatacctgtttgttaaagaaaccaggaaatacagatacatgcaaagaaggaaatgaaaaggaaagagaaccacaaatgatctcactacttagagataaataaactgttaactcttcatcatatttccttcctgtctgttttctttgcacacgttttaggttattatgtacatatgtgatcccaccaaactttcaagggtgtaccgtgttctcttccttaacatatcataagtgtgttccacacagtcaggtcttcttcataatggctgcatatctgtgtcaccagcttttatcctcataccctcagctgcatcagtgtgcccctactttcttccccagagtcattttactgtggcagtctgctaaatcattcttgccacatgtacaaacctggaaacatgagagtcaatattcactgaggcaaactttgatgaaaagataaatactcttttcttccatgtcttgggcaaacaatccaaggtgcattccattggatcctcagagaattcccagtggatctgagctttacttgcccacagcagtgagcaactcagtaatacaccttagattggcttttcctcttttcctctttcgttttttcccgtccttccctcctattccctggaaccatttcccaaaagaaacttgtctcagactctacttttggggagaatgcgagctaaggcaatactcttctaatcaaatgggtgaagcatcattgttttaagcagtcccacctgttggaaacatagttggctcttgctttttctctattttaaactgatgtggacctttcttggtatgaagcttttctgtatctaggcaaatttctcaggacagaatcccagagatagaattaatgggtcaaaatgttgagcatttttttagggttttcatcctgcactgtctaaagcagagcaggtcagcttctggctggccaggctagctgccacttaatcgattgaaaacctcttggtcaagctttcgtggcctgaaggtataggaagcatggcctgcatacagtcctcataccatctaccaagcatgggtggcaggaccacgtcagaggtggggacaaggacatggccatatgagtttgctgtggctgccataacaaaatgccacaaactgaatggcttcaacaacagaagtgtactgcctcctagttctggaggctgcaagtctgaggtcaaggtgtgtcagctgggttgattcctcctaagggctatgagggagagtctgttccatgtctctcccctagcttctgggggtttgctggccctctttcaggtttcttgtcttgtaggagcatcattcagacctctgcctttgttttcacacagcattttccctgtggtgctggtttccaaatttcccctttatatgaggacaccagtcacattggattatggacccgccctattcctgtatgacctcatctgaactgattacatctacaatgaccctatttccaaataaagtcacattctgaggtactggggcttaggacttcaacataggaattttgggaggacataatccaacccctaaaaatggggttgtagcccacgcaggaaactctaccttgggccctgtccctccatggaatcaatgagaaccaagagagggctctccttcgatctagtcccttagaaagttatggggagaaggctgggcatggtggctcatgcctgtaatcccagcactgtgggaggctgaggcaggcggatcatgaggtcaggagttcaataccagcctggccaacatagtgaaaccccgtttctactaaaaatacaaaaattagctgggcacagtggcacacgcctatagtcccagctactcgggaggctgaggcaggagaatcacttgaacctgggaggcggaggctgtggtgagccaagattgggccacttcactccagcctgggcaacagagcaagactccatctcaaaaaaaaaaaaaaaaagttatggagagaaagagccacagctcctttctgtaagtggatgtggagtggagcttgtctcaaaccagtgccctgaaccagggtcctaaggcaccaggccagcacaggtcccttccaatgcatgatatcccagcgggaccagaggaaccacagagtagagcccatctagctcaactcctcatttctccgagaggaatccgaggccttgagagggcaaagagctcacctatcacagaacaagaaagtgacagtcaggcctgggaccaggtactctggactcctatgcatgccccacagttgactttctccgctttttcctcttagcacagactctcagagccatgaggtgcaacagaagcccagacgggattgggatttgctcaaagttgcctagtgagtcagtgacggggctaggattggaatcgaggtgtgttgactcctagctctatgccctttctggaatccctacacatactgtccagccctgtttcccacatcacataccactgacactttgttaacaggggtgtcacagcaaaattttccagttgaaactcacttgataaatgctaaattcaacaaagttaaactgcaggacttctcagggccttttctttgccatgtgcattgggattctccaaggcaacagtggaatctgcagggttttcccagctgctttgacctcagaaaacctttatctgtgaacccctgttgatttttctctagacccccaggatgggcttctgaagtccatgagagcctggaggtctctttgcagggcagcaagtgatgtgtggcatgaagcagaggaggggtgagaaggcaaaggccatcagacccaggcctgcctttggtggactcaagaactggaatcattcaaaccttctcacagcaacaccccttaaaaaaagctgctaatgcattctgtgctgaggtcttgtagttgtatttacctcattacaagaaacaactagttttcttttctgttctcacccatacctaccctagtgcttggcagcacctgcaccctttagcttatagccaagaaaaatgcagctcactcatcagggcaatttctctcctcatgacagagcacagttttcccagagagagactgagactttcctctagccaatgaaggggattcaaacggtcccatgggaaggatgtgggagcctccatgctagctcctgggggaagagccaggcctggtcctgcccctatgtaccttcagtctgttccacttggccagggttggcatggacagtggcattgccgatctttggtgctgggccctttgcaaagaggggctgatggctaggaaaggatgaggacttctctagcaattcccgaaatgatttcaccatgaggtccaacttcgagggttttagtgtaaataaggcaaacacacagagatgaaatctgccttccaatcaacttgtttcccaagctgagggaacgtgtgtttggcaaagaaatttagctacagcccaagcttggcaaacccagatggatgtgggtaatgaccctgaaactcccaaggtagaaaacaacaaaggcaggaatcccaaccatgggctgacctttgcatgcaagaatatgatgtcatctcataataaatatcttccaatgcagctgctcatgtctcagctctcaagacagcctgagtacagcatacggtctatagtagacttaaataggcattatgaagcatttcaatttgaagacaaaaggtgtggattgaggtccatgtgcccaatggagtctcactattattctacaaaatccagtgaggtaggtatttcttccctttcacagatgagcaaatggaggcaagagaggtgaaatgttttgtccaaagaccacacaactcattcgtgacagagctatactaggctttagaagcattgcatctgttataaggaagaagaggctctgaattggcactcttggctagcaaggagaagggagaagagccagccaggggttggggtaccatgcaaaagcccagatctctgctccctgctcaatgcccaaggagaatgagagaaagctagaagccaagcaggcaggaaactcccattatcagcattcaggtctcttgtcatcgaaggaagtgtgttctctgcccttgcttcaggggaatttaggagccccatacaagtcggctagctcagtgacttcctgctctccacccgctgggagctggcatattgctgactggggggattggggagaggataggcaagtcagccgatctcgcagtgcatgataaaaggtgtgctctgaagttggcagaatatcctgtttcattcactaagcacccagccagaaatagagtgagagctcttacatgcggatgccctggcgagcttggaaagtgagaaatagaaatacttcagccacaacattttctatcccaacttcaaatgggagagttaggtaattgtcacttagtcatactactaacggggcacaggaaggaggagcaggactggctgtggtgaaagccccacttctcagctcccctggaatcaggtgactggccatatctgtgctgctcaggggcctaggagctagaaattgagagacaagaggagcctgccccccatgtcatccaactgacaacagctagaaacaagaagccccgcttggatccccaagatgagcacttcagttgcaagctgcggaagcaggttttcctggagcccattggaagagccagctccaaggctgccctggaaggtggatgggggcttccggcttgggaagcctccaagcttctggagggcgtctgcttaagacggaggctgcggttagggccaccccctccaaggggcctcacctaatgccacagccactgacagcctcaacttggcttctggaccagaatcctgctcacagtgaagggctagtcaggagtgacaacactccaaacctcagagcccaccaaaaatggcattaattatgttgatggccctgaacctgatttagttgttgatcttaaaattgagggagagaaggagaaatagtctactgagaaaataaaaaaaatcctgtggagggtggataaaagcttcccagaatacctgaatacccccagaatacctgagactgggtaatttcttcataaatttttataaagaataaaatagtatgcaaagggactaacacacctcccaattaataaattgggaagctgatgcttacagccagacagatctcttctgggtcacacagcctgtgagcagtaggtagatgcaggaattgaagtcatggctccaccataccatcacatggccagttgtggcacaatataatgctcagagcattttctggagtcttacagaaagtggtagaggaaattatagggtggggtggaagtggaggtggaggcagaagagatgatgttggtagaagtaatgatggtggaaggtagtgaaggttggggtggaggtgatggaagtgatggtgatgatggatggggagatagtaatgatggtagtggtggtagtggagttggtggagatgagggtggtgatggtggaagcggaggttttgatgctgcaggtgtggatggtagaggtgctggtgatggaaaggaggctcttgcatagtccctgagtcatgcggctgtccttggggcccttggtaggggagctgaggttactcggggaagaaggcagaaggaaggggatggttagtggtaggagatagagagagagggaaaggagtttactgagccccactgcatacatcttgggtaggatgggagtggcatttggcattggtaatcaccctgggctggggaacacgtgagcacctgaaggttcaggctgcagcatggttcttatttatcacttaattgttcctcctggaagttcatctcagacagaccagctggggctgtggagggctacggtctggtcctctctctcagcctagctaatgggaatgtcaccacatgaagtccttacactgcgttatgcccttccacgagcagaggccaagatgggattattatccaaggattttcttttcttttcttttcttttttcttttcttttttttttgagatggagtcttggtctgtcaccatctggagtgcagtggcgtgatctcggctcactgcaacctccgcctcccgggttcaagtgattctcctgcctcagcctcccgagtagctaggactacaggcgcgcaccaccacgcccggctaattttttttttttgtattttagtagagatagggtttcaccatgttggccacgatagtcttgatctcctgaacttgtgatccgcccgcctcggcctcccaaagttttgggattacaggtgtgagccaccgcgctgagccaggattttctttataagaaattcctgtgagaaaaatgaggaggtagcccaggaagtctgaagaaccaccacaccacagtgcaaggctgaccctgagtgaaagagagagaaggaaggttgtattaaagtgtctagaccaccgtgcagtataagaaaggcttggcaaggccatcaggaagtcctcaacaagagtcaatcaccagaggaggcccctgtctcccaggaatgacctaatttagtacccctgccagctcagtcactggccataaacagtccgtgggaagcatggacccgtgcaaacacagagatggatttcagagcacactcgctggggccccaggtcaaggcctcctcctgcagttggacatctgtgaggtgcattctcacggtccccacacactcctttgctgctcacctgtctctaccagctttcaggtggctcagagctagccaaaacttggaagtgacagaggtggctcagagctagccaaaactcggaagtgacagaggtggctcagagctagccaaaacttggaagtgacagataaccttccgaactgaatttaagaactttggcttctagcccaggctctgacccactactcatgtctccccaaagaggaagctgtgctttattccttgcaaagccagcttaggttgagtgacttgctttggagtttgttttctattttagtgcagaatgaggcagccttttgcaaggcacaggaactagcccagctgcacaggaacctctctttttaatgcaccattagagatccacttacaaaagcctctactaaagagacttctcactttcttacaagggcaatgacactgctacctttcctttcattttggttccagagtcccgactctttctactttgttgctggcctgttagacgccttggatgcttttagtctattctgactcccattcacatctttacactcactctggtaccagcatctggatcatctccagagcactgagacacacacatggtggagagaaacagacagagacagagacagagacacacacagatagagagagagagagagagagagagagagagagaactgtacaactgtacactgctggagaggtaagtcttatgtgtgctagtgacaacatatcttagtgggaaaaagaatgtggtggtggaaggaggaggggaaatgtgtatttgattgtagtggaggggagcagatgaggaaaacaatcaagctgtttttcctactcccccagagggaagctacactctcagaagaggaaggaagaaaggaagaaggaagtgtaggaaggtacaggaaggacctacctcagactaggactaaccttccatgttcttttgtgcactgaagcctcccagtctgcagaagtaactaacacatcctttacctttttattctggggcccaccaaatacagaagacccctttgggacctcccagtaaatgtggtgactcacctatgtccttcacaagccctataggctggtcacactggatgactccatccttgttgaatgtgtcctctactttttgacttttgtgatttttgtcacattgtttctgcaatttggaatgtcctccccagctgtctgcccccatccattcttctatgtggcaaatcaaatgccccctcctccatgaataagtcctcttgaattacctcaaggataatgactcacttccccctcttatctccaagagcaatttgcttttaactcatttaaccctttattgttctgctgtatacatcactgtttctgattatccaagcatgctgatggagactatttagacaaaaacagaaaagcagaaacaaagaagtcaagggggagaatcacccataattccctcttccagaaagaactctgttaacattttggcatatttccatacatagtttctttactatatatacacatttgtatccttttcttttttcatgtatcatctctttgggtgtcctggaagcagagcccaagacaatattttggtgcaggtagtttatcgtggagatatgatagttaattttatatgtcaacttggctgagacacggttctcagatatttggtcaaacattactctggatgtttctgtgagggtattttttggatgagattagcatttaaataagggggctttgagtaaagcaggttgccctccattatgtaggtgggcctcatccaatcagttgaaggtctgaatagaacaaaaaactgacctctcctgagcaagagagaattctgccagcagatggccttcagccttcatctgcagcagcagttcttccctgagtctccagcctgtcagcccaccctgcacattttggacttggcagtcttgtaatcacatgagccaattcctcaaaatcaatctctttctttctctctctctctcttttctttgaagaaccctgactaacacaggagctgatcccaggaagcaggtatgaaggggtggggagcatgacacagggaaaaagggaccatcaatgttagtgtatgctactgaaggagctgctgtgggcaatcagaacttgattccgtcagggcctcctgggaagtgcctagaaagcgttccatagttgcctgcccatctgaagggtgggaggttggagtatttatccattggcccctggctgcatcagccaagggttgctcctggagccattaacaatcctgcacttccagattgtgtttataggccagctgggagggctcccgtagcttcgagtaaagctctggagctgaccatgcaaagacaggaggcctaatctccaggggagatgatgtcagtggtaggtgagtcatagctcccatggaagtgtgcactgcattgtgactgaaaccggtgggaatgtgatgtggggcatcagatatgtctactacccccattggaacagacatattgctccacatcatttaaaatgctttaatatcattccttttgatggatgcacaatgttccactgcatggatgtgccagttaggttgtttctaatatttttatcttataaataatgctgcaatgaacaccccttatactagtctgctcaggctgtcataacaaataccataggctgggtggcttaaaccacaggaacgtatttattcacagttctggaagttgaaagtccaagatcaaggtgtgggcagggttcatttctcctgaagcccctctccttggcttagcagatgaccattttctccctgtgtcctcacatggtcttccctgtgtgtgtcccactgtcctaatctcttcttatagggataccagtcagattagattagagcccactctaattctccacatacattctggagttcttggagagttagggctttaatatatgaatttttgtggggggggggcacaattcagcctctgagcacactcagttgtttctgagtctgtttctcccactgaactgtaatctactcaagggaggtaactgggagccatttaacccagtttccccagggctcagcactgagctactgttgtatagtattgtggacattaacaatattacaactgactgcaagtgatgttgatggagcacttgccatgtgaaaggcacttcatggactttctccctctcttttaattaaaagagtatactttatatactcataattaattggtagtctgttgttggtattgatgtgtttatgcccctttaccctcccccatttataatataattgtcttaactattttctgtatgtacatagagaactgcctcagagaatgtaattagtttttgtttgtttgtttgttttgctgcaactgccaacataattcagaaaactcaagaggaggaggaatgtctaatgcatttgcccatatttttattctttcttcctgcctgatgtcccaagattccttcttttatcattcattttccctttctatttagagagctccccttggccattcttttaaggtaggtctctgggtgacaaagccttttagttttctttcagaaggatagtttttctggatattggtttctggattggcagttcttaaaatatgttgggtcaattccttctggcctccatggtttctgatgagatatctgctgtcattcaaattgtcttttcccaatagggaagatatcattcttctgaactccagtcatgatttttcctttgcctttcattttcaggagtttgactgttatgtgttgtggcattgatttctttgaatttatcctgtttgggattcatttaacctcctgaggtttctgttttttgccaaatttgaaaaaattacagtcattatttctccaaatactttttcaggctcatggtcttttcttaattctcttcctgggactctgatgacatgaatattgatctttcattatagtctcacagatcccttaggctctgtttatctttttccactaaattttctctctgtttttcagcttgagtaaattctgttgttccaccttcaagttcactgattttccctttgtcatctccaatctactattgagtctatccagagagatgttgatttcagttactgtgtttttcagatctaaaatttccactgggttcttttttatatctcccatttatttgctaagattgcctggatttttatttgttgcaaacatgtttgcaattgatttctgaagtagtttggtgacagatgctttacagttcttgtcagataatttcaacatctgatttgtctcaatgttggtatctgttgattgtcttttttattcaagttgtaattttcttagttcttggtataccaagtgattttgattatatcctggacattttaggtattatgttgtgagactttggatttttgtttaggccttttgttatcacaggccttacctgataccacttgttgggtaaaggaaagtgctgccttgttattgctaggtggggttggaagtctacgttcttcacttaatctcctttgacaccctgggaggggcttggggaaccttgttactgctgtgtggaggtgggatttcaggctccccactaagttgccaatgatgccttgctggctgaaatgcggagagatactgccttactgctccctatgtggcctccatgacactgtgggtggtggtctccttagcgctgggtgggaaagaacattccagctctctgactggtcttcttggataccacctgaaggggaggttggagtgccttgttctagcctggtgagggtggaagtatacgctttccactcagtctttgctggtagggaaggggtgaggaccatagtgttttctgtgatggttggctggaatagaatcgttactttgtaaaggttttctgtcttgctaggctgcccctttcctagtcctttggctagagagagaaggcttttctttggggccttttttggtctgctcctgcagatgtttctgggttgctggtttcctcagctctaaatctgggatatgtaaggtaaaaggaaaacccagggaagacacccttgtgttattccccgggtcctacagtctctaacttgtctaatttcttctctctgcctttcagaatcttgtatgtttgttttatttatcacgtccaggggtttagctgcatttaatgagagaaatagggagaaatatgtctattctctcttgttccagctagactttatctcttttaacccccataacaaccctgtgagacaggtactaatgtcctctccatttttaagatgaagcatttgaagccaggggaggtcaaacagatttgaagtgctagagtctgggctagaacccgggactcttaactcctggtgcagagtttattcaatgacataaaacacatttccatgtgtcccatattttttgatacccaataaaacactggcagaacacagcaagaggggatcagcttgtcatcaggtagttgaaaggagaggtgtttaaaaaaactaatggacttggtgtcaaagaatgaacccaggatagacagcaggcatagggtttcaaatcaaaggtttgtcccatgcaagggtgtttcatgataggcaatggctctgctcgcccatgccttctgagggcaaggaatgggatcctctcacatgccaacctttctggccagcatgtctcttacctggatttctcagcataaggtcctggttcacaagttggaagatagatgggcaggccatgagagcatcatgttgagagccaaggcaaagccctacaggcatttccaagctacagatcagtggcagcaggcctacacacttctcttgctccagggagcacaggtgggtatggtgagaaatgtgcagggttgatctgtgacactcactgcctctttatgtccttggaagcacttgcctattctttacctcattagagactccacttctgttagtattattatccccagtttacagatgaggacactgagggctagaaaggaaaagtggcttgtagaaagttctgtaactcctcaatgtttgtgtatctggctttcctattattgataagccccttgggggctgatggagggaccatacttgattcagttcctagtcaccagcattgagctcagtgtccgatacagaggtgagtgcccgatacagcatcgagctcagtgcccgatacagtatttccttcctgtttcctgctttcctgctatccctggctcaattgtgggtgggattcaggtgggggctggaacccactagagagtttcaactcttgtttgtgtgcaggaagccaagccccgggtgcaggcagaaagcaaagatgaagagggagcccactataaccagcccatctgaccttggggcttttgacacctgccccaccccctacttccagaaagaccaagggatggatggcctaaggcttggcattaaccaagaggggcattgccagcatagcagcagggtccgtgggcaatggtagggtcttttgctgccttctccccagtgtttagaaaatcttcttgtgtataggcctttagcaaccatcccccttcctgccctacctggtgccctttgagtggcaccaagctggtgacttcatgttaattacaagtgttcaattacagggccccagactgtggctgagcagacatatctcatgtcacatctttttagaccaggctgagcttatatatgtgctgctaaatagaaatactgctatcagataagattcataataaactgctacttagtctgagctgggagctgctcaggagactggaggaagaggattcatctcactcctccacagtgaggctcttggtagcatccaataaccccagtaatttggtgcacttggccacacacacacacacaggcacatacacacgaagcaattctctggtggtgtttttctccatgaccaggcaagagagaaactattttacagcattatagaatgactgtggggtaatggggcccgttgtatttccatggtagctttgttacggtgggcactgcagaaactaggaaaggggctgtcttcactgagtgaccattgggcttgtcttgagaggggcaggcagcaatatttttcctgccgaccaaggtgagtcaaactcctctggtctgctcacttggcctgaaccccacctaccagggccaggattctactaacagagccagggaggtgctgtgttgggggcttgccaggctggtgggatggtatgggagactggacatgccacctggcaagttggcataaactggtcaggcctactgcattacgggtttagggaaccctttcccctgggagcttgtgtgatgggaagcctgggggaagggtagatgcatcagctccatgtctgctgttcctgggatagccatccacccccaaagacactatatgtgatccaactacacagctattactacctgagccctgtggcatttttagatttggtggcagaaggtgtacttagtaagaagaaagtcttctacttatgaatcaaatcaactttatgtttttcaattctcttcagagaccaagtgtttgtatccaactaggcccagggaggctggaaagtttgcaattctttacttttaatttatttttatttttatttttagaaacagggtctcaactatgtcgcctggagtgcagtggctattcacaggcacaatcatagtgcgctgcagtcttgaatgaaagtttgcaattattgattggacttctgatatgtaaccttttggcctagcatcttctgttagtgctcagttaagttacaattcattgaactcatactacatgctagagcctgcatataaataaagcatcttcttgaacctttacaatcaacctgccaggatgtatgagttttctgtaacaaattaccacaaacttggtgccttaaaataacagaaatttattgtctcacagttctggagtccagaagtccaaaatcagtatcacttcactgaaatcaaggtgttggcagggccaagctatctctggaggctccaggggagaatcctttccttggtttttccagcttctggtggcttctggcattccttggtgcaatgactagctgcttgtgtccccctaaaattcctatgttgaaatcctaacccccaatgtgatggtattagaagatggggcctttgggatgtaattctgtcatgagggtggagccctcttgattggcattagtgcccttgtaaaatgaacatgacagagctctttgccctttctgtggtgtgaggatactggaaaagtcagctgtctgcaacccagaagagggttctcaccagaacccgcccatgccggcaccttgatcttagacttccggcctccagaactgtgagaaatcactttctgttgtttataaaccacccaatctatggcattttgttatagcagcctgaactgaccaagacacctggctttgtggttgcatcactccagtctctgtctctgtctattctccctttcataaggacacttgtgattaattttatggcccatctaaataatccaggataatctccccatctcaaaatcctaaaattaatcacattttgtgccgtataaggtaatgttcacaggttctggggattaggggctgatatcttttgggaaacattttccagcctaccacgcaggggctgccgctagtcttccagggggacaagatgaagaatggcttccaagcagaggcatgatggaactgtgagcagttgagcattgctgagatggagggggccggctcaggacaagggtgcagtgagcgagtgctttgctctgaagtcaaagtccgtgtgggattcctctgtgttcctcctataaaacaggctagcccagggcacaagccagtactaggtctcaggcaggcttggaaggaggcacaaaatggaggatggatggaagaatgagtggatagatgcacaaatggagggctgaggagacccacgaacatgcctggaacccctcagcctatccatctgcatttctccataatcaagatcgctgcatcactgcctggcagttttgccctttatccagtatatctcatttgctctgttcgttgattcggattcagagctgaaatgcctttggaagctgaaatgccaggctgctgtaacaaagattctttgaaagaaatacctttggaagaaacgccttcaacagtctgtatagctccactcaccagctcaggagctcagatactggccaggtgtctgtattctctccctgcggcaacagggccagcttcacaggcactcctctttccttcctaggcaaggcctctgtgttttttcctgcacaggaggctggagccacgggggtgaggcctctctctctgagtctcttgaattttactccagcatggccgccatcctggctggagctgaattcaggcttttcttcctccaaagagcctgtcctggtctccacaccacccctattgaaatccagttcaatggcaacactgtcattggaagaaagtctctctcattcttagatgctcaattctatttagactcccccaacttagtcagatgagctgtggtagtctgtcattcctgcaggcagaatccgcttctgaagggctttctgtgtttcgagagcctcatgctccctgcggctgtatccttcagccgcacataggtaaccgttgctgctgagttacacctctcatgtctgagcttgagcccctgcgtgaccacggaaggcagagcacgtttctggagcagccttgttgttaccctgtgtctacagagaatagtaatcttgggtggcggacatgatagaaagaacacaggctctagagtcacacagatcggcatttggctcttagctactcctgtgctagctgcgtgacttcaggcaagccacataccctctctgggccccagagtcctcatctgataaaggggggtgtaattaatggtccctatcttatagggttaatgtgcatactgaataaggcaatgactgtcagtgaatgcgagggctcctctgtcctcctcttgaactccagctcttggcagtgagcccctgggagggtgacctctccagggctgccccacccccacccccgggagagctttggagcttgctgtggaggagtgtgtgtggtgagaggggtgggtggacaggacagatgcactcaaaaggcagggccgagtcagggagcaggtgggatgcataaggggttgagagggaaaagggctgggaaggcacatgtctgtggcagtcatgcctccttcttttcctacagcatggactggaggttgtgttcagggcttgcccattccctcctcagaactcacacagaagccttataggaccacctaggcattgtattagttgggattctccagagaaacagagccaataggaaattctctatctgtctatctctctctttctctctatctatcgtgtgattgtgggagctgacaggtctgaaatctgcaaggcaggcaggctggagattcaggtaacagttgatgttgcaggcttggattcaaatactggaaactgaggcagggtttatgcattgcagtctagctttgggaaacctcagcctttgctcttaaggttttcaactgattggatgagtcccactcacattatcaaggattactaatcttcttttcttcaatcaactgattgtaaaagttaatggcatctagactgacaaaattactgagtgccacagcctagccaagttgacacatataattttctaaacttgcgtaaatttttgaggtaagagtgtaattttgttacatgcataaattgtgaagtcagggtttttactgtatccaccacttgaataatgtacattgtacccatttagtaatttctcatcatccacccccaccccaccagtgagagttaaataatgtgtacacatggacataaagcgtggaataatagatacatgtaattaaccatcatgggtaccttagctgcctgctgcagccttttgtcagggtcagtgtctgatcagaaaagcaaaccctgggagcctggatgttgctcctcagatgtgagattgtaacagtatttttggtggcctccaagtcatgtcaccacatggtggccagacactgggggctgaattcctggtcacactttaaacttcatttttctgagcacgttctccctaagtggtgggtgtggggcacagggaccaggcaagggagttgggtgcttaggctcttaatattttcccctttggcaattatcttttacccttgaacctggtggattatttccaatgtctttcttggtctcctgtccttggtaatacacatatggctcattcattccctttgatgcagctctttactgcagtttgtcagtgtttcagccatgtgatgtggtacttactgcagattgtcagtgtttcagccatgtgatgtggcattgcttggcttcaaaatctaggatgtgaagggctccttgaagatcaggaggtgggttgatgtacagaacctcagggttctcaaaatgtctctgctccctaccccaaccatacacacacacatgcacacacatgtgtgcacacacaaatgtgtgcatatgcagacatgcttaagaagctcaccaaatgctagaaggaatgttttgaggccttcaaggtgtttggacttggattctgtgacatgtccagaggtgcagtgagctgggtttcactgggttaggtctgaaacgggccacaggggatttttgttttaatataccaggatatggcaaagtgttggatttggtgagggagttctgggtgtttttcctcttttgacagctgagaacaagtgaatcttgtgaaaacattggagtcgatataggagggctgtagaaataccaagaaaggcccaaatagtggtgcagcaaacaaaaaaaatgtcttccaaaagatatccacattgtgaaccatggaacgtgggaatgtcaccttatagggcaaaaaaaggactttgtagatgggattaagaattgtgagaggagaaggttaccctgagttacttaggtgtgccctaaatacaatcacaagtgtccttctaagagagaggcagagggagacttgccacagacacacagaagagaagaccttgtgttcacaaaagcagagattggaatggtgaagccataatccaaggaatgccaatagccaccagaggcaggaagaggcaaagaacagaatctccgctggagcctccagaaggagtggggctctgctaatactgatcagcccagtgatactgattttggactcctagcctccagaacagtgtgagaataaatgtgttgttttaagctcaccagtttaccgtacttggctgtagcagcccttgcaaactgacacagaggggctgatgtgagtacccttctctggcaaaaggaggggtggtcacgaactggctacactgggagggcccatgacaatggtctgcatcaggcctcttgctgatggggaaactgaggatcagagaagggaaaggcctcactgagagtccacaatgaggcagtggctggctgagaccaactcaagtcccctgcttcctggggtgggcaggggtgcagcctgcacacttgttctttccaagagatttggcttcctgacttttgttttgttttgtcttgtttgtttgagatggagtctcgctctgtcgcccaggctggagtgcagtggtgcgatcttggttcacttcaccctccgcctcccaggttcaagcaattcccctgcctcagcctcctgagtagctgggattataggcgcacaccaccacacccgactaatttttgtattttcagtagagacagggtttcaccatgttggtcaggctggtctcaaactcccgaccttgtgatccgcccacctcggcctcccaaggtgctgggattacaggcatgagccactgctcctggccgtcttctccttatcttacaagctcctctacccagggattctcccactgcctgtggcttccctgtcaccagtgctcactaggggaaaatggctttataccttttgcccccctgagtctcaaggcctgaagctcttctggacactgttctggtctagcttcctgtgggcaggaccgggccccctcactatcagtcttcgcacttctgcctgactgcctatttgtctggctcccctgctcagccctctccctgccagataactcaccctttagctggctgctcctctgtcacccgcagtctctcgcttgccacaagaacacacttcaatgccattagcactaacaccaaatacacaaaagcttgctcctgtgtgcagcttcaaaggatctgtgttccttagccagccattccaaggccaggaccccatttggtaggctgtcatctttctagtactgaccagcccaaacagcaggagaaaagactggctggctggcactaagctctctctccccactggctgctgacatccagcatgccaaaaagtggggagcccaaccttgacctcgccagcacattgtttcacctacaccactgtccccaaggccaccaccacaccagcaccatggcagccaggagcagatggaaagggcactgctactcatttgaaaacaaatgccattgcctaagaaagacaattctgggccttcgatcccaggccagccctctggagagctgaggacattgcttaagactcccacacctgcctcagatgctgtgggcttgggtcccctccccacttggggcctgtccttcccagaagactgttgtttatacctaggcctcttacagtatagaacccaaagtgaaccgagccttatagggatggaggggtatcaggactctcacccccgtcattctggggattctacctctgaatgcacaccatggcatgtctggctgccacagctccctgctgactcctttctccaagctcacttccactgccacattctgggacacttggtttaggctctctcagttgaggctctcacattacttcttataactttgttctgtttggcccacattcttcggggctcctggggctggagttagatacaccggctgctcctctcacctctgtgtcattcatagttcacactcatgtcttcttgctcctcctttagggtaaggtcccatttccctaaacaattatatgagtcctgaactcaaactacagacctactaagttagaactctgaaggtaggcagtgctccagccctttcaggactggatatatttcagcaagcaaagttgcctttgaagtgtatctctacagggcaatgttgactcatcaattgccatgatgttcttcctataggaaaaaaaacctagttgtctgagaccaaagccttttggtcagaattgggctaaggtggggtcttatccagggaactttgtgctgggactaaggccatatttgtgtccccttgaaacaaccttccctcctttaatacattttttgcagttgctgtaacaaagtaccacagatcgggtggcttagaacaccagaaattattctctcacagatacagaggacagaaatctgagatcaaagtgttgtggggctgtgctccttctgaaggctctaggggagagtgcttccttgcctcctccagcctctggtggccctaggtggtccttagcttgtgctgcattgctccagtctctacctccatcttcacatgccctcctttatgtctgtctcataacgatacctgcaattacatttgggacccaaccagatactccagaataaactcttaatctcaaatcattggcttaatcacacatttttgccatataaggcaatattcacaagttctgagaattaggacacggatatattttagggggctaccattcaatccatgacacacctttaggatcattcagtagccccaccctgggctaccatgctaggggaggccatgagttcaccttccatgcttccagcttccaggatgggcctatacccttgcatctactttacatactgagactccagcacgacactgctacaggctggttggcagctgctgggcgaccaggtggatgggccaggaggagatgtggtattaacgggcagcacagtcaatgaggggaaggaaacacattagtgacgttccagcttgaagtgacagtggacctggggctataaaacaacatgggtttattaatggacatttagaccctaaaagcaagagggaatgcaccggagtgcagcagtgtggtatagcagcagaagagacaggacaattctgagagctgtcgcccaagcatcatatccatatcccagaactggaggcaaaaataatccacacagcacaggaagctgtgcaactctttggttctagatggcattgaccttggcctatgtggaggggctgtctcctgtaggactgtccgccacattatgcagatgatgaagcaaggctctgtggttttgtctttccctccttttccaagccagctactctggaccttcactcccactcctcatcctgcatcaataggaggctctcctgtcagacttcctgacccctctccagtgccagcagactcaggcacttcagggccaaaagtagccttatttctttgctctaaaagcctccatcattcttcactgtgaaaagtggtccttcctgaccttttataagtattagaccacctaaaaaatgatcgtatctgtgagcagatgaggctactttgacctggagcagtgacctgggtactgattattcaaactgggcactggctggacctgctgaccatcagctctgcctgcagccactcagggtaaccagtgcagaggcactgggtgaaggatggcatccagaatccttgcaggggaactgaaaaccctttgggagccagccctgtctgcctcagtaagggagtctggctttccttgattcatagacccccaattgtccacattggccagactggctggtcaaagccttctggacagtgccacatgcttcccacatctgggcccttgtgtctgttgtcctgtcacacaagatgccttctgcttcgccaagtcaaatctttcccatcttattgggccaggtttgggggctgctttgtttgggaagcctttcctggttgctttagaacctgttttaatttgttttgagcctctaacaaaagacccctgcatggttgtttagttgttgcatgtgtgtgtgtgttggtgttgactctcctgcaagcttggcgagcagaggccaagcgtggtccctcactgcattcccctcgggtcagttcagggcctggaatgcaacaggtactcaataatgacagcaaaatgggcttgagtgagggacagagtgacctttctcaaatctaattatgctctaattagccacagctgcagctctctccaaatgaagatgaggcttggaatcaggccctgcctagcttccagcccctgcttccgtcctctcccaactcctgacctgcaggcccatccccaggaacttgtcagtcctggagccatctctaaatctcagcccagctcattccatcttggcccaggcattggagctctttccctactgactgatctccggatcctggtgtgctgtttgccatgaactactgcctgcctctgtttaccatctgttgcaatgagcccagttcttgctcctgccgtactaggcctccctaagggctgctgccggtgtgcctaggggctgctatggactgaattgcgtcacctcaaaattaatatgtcaagccttaagccctggcatgatggtgtttggagatggggctgttaggaggtaattaggtttatgtgaggttctgagggtaggaccctcatgatgggattagcccctgtaagaagaaacaccgagtgtttctctctctctctctctctctctctctctagatatatatatatatccctagtgtgaggacacagtgagaaggcagccatctataatccaggaagagcaccctcactagggaccgatcatgctgacaccttcatcttgggatttttacctccagaactgtgagaaaataaatgtctgttgtttaagctcctggactatggtatttgttacatagcctgagctgactgagacagaggcctacctggtctatggccccagcccctcccagactgggataggctgaataatgcccctttcttccaaaaatggccatgacttcactccctggaatctgtgaatgctaccttatatggcaaaagggactttgcagatatgactaaattagggatcctgaaacgaggagattatcctgaattatctagtttttcacaagggtccttataagagaaggagggaggcaggagggtcagattcagaaagagaaagagagatttgaagacactgtgcttctggctttgaagatggaggaaggggccatgagccaagaggtgaggcagcctccagaagctggaaaaggcaaggaagcagattctccctagtctgcaaaaggaaccacctccacttggcaccttgactttagacttcctgaactccagaactgtaagagaataaatgtgtgttgttttgagccgccaagtttgtggtaattcatgacagcagccacaggaaactgatacacagccccatatttctgctgtcctccagcactagcctgtcctgtgccttcctcctgagaatgtgtctgaccctgtttcctgccaagcatctacctcagcctcatcctaagttctccccagatggtgcagggaagtcttcccgccttgtctcagccctacgaccctggcctccctctgtacctgcaatgccagaggctagggaggcaggccccaaccaccagcccccatagccagctctgttgagaagttaaggacctaggaaaagagaaacaccctcccaagaaggggagatgccactgggggagaaggatccacaggaggatttcaagaagttgatgaggactgatgctgaacacaggtaatcgttcccaagggaaggcaagccgacatcacttagcaggcagcccaagggtgctctcaacacctcagagacacagggaaccagtggtcagccagcctgtggtcccatagcatctggccataatgactcatcgagaagcggcccagaagccaggggtgcttgacttcctggccccgtctgggcaagtacagggtatgagtggtattgtcagttgtgggccagccaatcagggatagaggtgccgaggccaacatgtcagggtccctggcacagagcctctcaaggttgtgtcttcctcaggggaactttcctgcatcttgccttgggcctgggcccagagaggataggatccaattcaccctggggagcttccacttctggcaatgctgagtaagctcctttgggaccaagcctcctgcggatgacaactgtgcatttcaaaccaaaccaaaccaaaacacacacctgaaggcactggagagctacccaaagcaggcagattctggaagaaagtcaacgcttgggggaaggaaacagtcctggatgtacttcctgcttacacagcttctagcctggggcagccccactctgcaccttgcagggtaaccccaaggcaaactcacagtctttctggtatgaacaacaatatgacggccttcagggcaatcatctcagctgctaaaaagtgaaggggaatcctatagatgggagaggcagggaggagtcctagatcctgtgtatagacactgcccaagtctctggctgacccctgagtcatgcgtgcatggggactccaggatgacatttctggaaggtcatctttttcgtataccttacctttccctggcatttagtgagcacctaccacatgccaggctttgtgcctgatgccaggaagccttagtctggttttccccgaaagcagtcttatagcgactaagattttaccaggcagtgggatgccacagggggcaagagtgaaggaaaggggcagtgatgccacaatggagggaggacccacgtgagatgcactgctgatctggtggctgctgtttgcgactgactgcttgaccctgcataaactcaaggcatgtgtctggaaggagaagaagaatgtagccacaggctcccatcttccactcatcaagggctcacctcttatttctgggttgcacatgaatgggtgctaagcaaggctgatcccacaacaccccatgcttctaggccaacagggcaaccttggtgggtggtgtgaggttcacagtatgggcatgaagtgaaccctcttactcactgtgtgactttggcacatgacttcaccttttgagccttgttttgtcatctatgacaaggagacaagcatcactttttctgcctacttcccaggaccactagaattgaacaatgtatgctcttcaagttaagcctgggttagcactttccttaaagactcggcttctctggagtttctaacttttatatgaagggtagttcatataaaaggcctgaattatataacacttggaattggctgcaagcaccttttgaaaataaactaaaaaaaaaaagtctaaattccacatgttcatctgcattaaagtcctcatgagagcatctcaaactttaaaaaaaaataagaaagctttgattttcagaaacaaaattggacaaccatgcatgcataaggtgaccttgtttcctttggcagtttaaaaatccagatcctacgccccaaactcacattagagcatctgcttcggattcaatttggctagaacaaagcaatcagtcctgctcaggcacatgcacagcattttcaccagagaggtgcagccagtggtccagtagatggtgggtgttaagccaccttcactgcctgttggcaactctacaccagcccagggctgtggcccaagtgattgggactttctgcaaccctcgaggttatcactttggagaatatcagagctagaactagccttagagatgatccaggccaaggccctaaccaaacaatgggcacactgaagtccacagagagtgtggacctggccacggcttaccatgagccagtggcagaacgtgacctggaagccaggcctccccctcctagcccagggcttgctctgcatccttgctagcccctgcctcattctctgagagccatttctgcttgggatagaggcacagatagacccctagaagactttctagaacaattaggatccaaagcaaatagtccatagccactttggcccaagccctgcctactttcctggctgaaagtgaaaggccccatgcagagtgagggccagagtgaggccagtgaggtgcccaagatgccgaccctgcacttgtgcacagctgaggtgaggcctccttagatgtctcgctggcttcaccctattccccatcccagaccccaaatccagtggctttcatgatagtcttgaggattcctccatcagacctggggcttctactctccagatgcctctgggttcctgggctgctctcccaagggcaaagctttgagagtcaacaaaacaaattgacactcatgatccatggggttctacaaccttcctttaattgccacaaggcaaagaatcttagctccttgtcctagatcgggcagccgaggctcagagaggctgagtagttcaaagctacatggcccacaggtggcagaatgcagcttgagcctagcccttcaccctgccctttttcgtcatcctacatccagctcctccggaactgctgcctgcccacattgctcacagtgaccaggcaaagcctgttcttgaggcctttaggcagacttaggcgctcttcctcctgccctgtaggacccacagcagcaccagatattgttaggcaaacgaaaaaagttataaggctgaaataattgccctcattttgaatctgagtcttttcagataacataatcttgtgcagccccaaagaggttcctgcctgctcctgacgattgggatggaacaagcccaggtaattgcctcttctgtgtaaagaccaatttgtccagggaaatgagcacagttgatgtaatcaattaaaacactgaaagccgtgcagcatatacaggaaatggaaaataaattggagccctctgccccgcctcaccttctcaaatgcctgagtcctgcctgaccaggtgacaatttttttcctctttgagcctcactataatttgagtaaaggaggctgaactgacagggtccctgaggtcacagaaccctggctccccagctaggtcaggctcctctgtggggccaaggggcgtggaggaacatggggtttctcctgtgcttggccctgtgctggacacgggctctgctcacactgtgaggattgggggcagagccatagatccaccagggccctcttcacagctgggctcttaggttaagagtgggtgcttgtgaggagctgggggccagaacccagcagaagtgctgctgtgaagccttgccaccaatgaagccactggggtctaggctaagttttttttttttttttcggtgtcttactctgttgcccaagctagagtgcaatggtgctaccatggctcactgcagccttgaactcccaggctcaagtgatcctcccacctgagccttcccagtagttgagattataggcaggcactaccacattcagataatttttaaaagttttttgtggaaatggggtcttgctatgttgccagggccggtctcaaactcctggctcaagccatgctcttgcctcggcctcccagagtgctgggattatagatgtgagccatcaagctttgcctgggctgttttttgagcatggtctggcctttgaatccccatttgccagccctgtgctttttcaggctatgctctggctaccgaggcaggggaggctcgagtggcttatgcccactgacatggggtctgctcactggcttgcagttttgtctctctggcctggtgtttgtagctgtgacacaggccaggctgcctggcccatggggtccctgcctgctgggagctcacagtctggagaggcaggtgcatgcatggtgctgtgggaagtgaggcttcagactgccacagctgagcaggcttagtgcttctctgtacacgtatctccagggtgctcggggaagtagagaggatgagacggtggcaactgcagaaatgaccgagacagagaagatgagaagcaagctacagctcttctcatttctaaccttgacccccagtaggatcccgctgtcatccttgtcaggtaggccttgttcgtctctcagaagaggagcaacagatgtccaccagggcaggaatatcacctggggctcagaggttagtcttgttttagggaaactcaccacagttgcctggggaattgctggtgacccttttgggaccacaaagtgacatggaaaagtcttggtcataatcttgggaaggaagtgcatccagggatggacaagcttgactaaggaacagaaggctccaccactatttggagtgactgggctcttcaagccatctgggaattgggtcttttcacctaggagaccaaggtttctagatgtggtggtgtctccttgacttacctcttagcttcttaagggaatgtagcacatctgattcctagctgggggttcacagagtgtgttctgtcactctaccccacccagattttgaggtctgggagcccatgctgcctgtaagtttgaggtaatggagaattgaggagaatagtctgcccatgccattcccatttgaccttggaagtgatgtggcttcaatctggctccttcttgaaggagtgtggggcagacagaccatgaggaagacgtctgaagcctgtgcacagtttgaaggcacttctgcctgctgacaggggtaggttacttcaacaaccaatatccttagactccgggacaaggaaggcacagggattttgacttgtattccaacattcacagactggaagtggctgaatccaggctcagtgggatgagcaccatgattgattagcaatgtctgccaggcaagcaggaaggaggggtgatgtcatgtgtgtaaatttcttgccatccctggttagggggattcatagggatgtacagggcatggcaaagatggaggagggggatggtacatgctttgcttaaaaatctcagtggctttctcaggtcaagtcaccttaaactccagtgtttgttttcaagctgcattcattccgtggtggaggcaattgggtggcaggtgtttactggcaatccttttgcttccaaaaatgccagatgggtttgtatttttattgctatggtagcagtgactcagggtctcgatggcacagtgacactaggcaaaaggtctggcattttcctgcagagaagaaaactgagttaccacaataagatgttcttactatatcctgctgtgacctccatcttccacagcaactgaggctaagattatttcttagaattgaaagagaatcagtatctcttgagcaaaaaccattgtgttttcctgattgaaagtctcttaataactattgttactgggctctaacgtgatgactgtactgtgaccagtctggtttgaatgtgttggattaagcaaaggtctgtgcccttggtttgagcatgtccttggtttagacccccaaagctcaaaatctgggtatagtaaagtgacagaaaacactctctgagaccccagaggtctaggatgtgtaccctagaaggccccagacaccttttatgtgaccaccttggcttgaatgtgttgcattaaccaagaggggatgctggcattgggccaggaagggatgccctgttggggtaaaagcagttgttgagataaaaaagtaaacttttttcctctttctagacaaactcttggcctcaaagtcttgaggattgctggttaaacacagtggattgagcacccatgtttatctgtgttccctctccaaaccccactcaaatgacagtaaagaaataaagaaaagcctgtacctgtaggagcaaaataatggggggaaatgaggcaactgcaaacaagagatgcagctggaaagtgaatggatgagttttgggtgaatttacagagtgaagagaacagaaatttaaatccgtgtaagccagaaagaagcaaagcaaactataagacaggaactgggaagactcaagaatgggaggcagcagggtatccttaaaggcagggcatgcgatagggctgagggcaagagtgctggctcagaatgtgtatcaagggtagtggttagccccttagtctcctccctgtaccagggcacaactaccctggcagaagacaggaggttccacttgctggagatatccagctaagcacactggtgaagtaacttactgaaaacagggattacttgaaagcttcataactgatggtgggaagacccccaaatttctctcctacttgcattccagaatgccaacacagccagatttatattgccccaggcaaaagatgggaggacacctccatcttgccagcaaaagagcagcagaaactgacacttgggagcccccaataaattaactgagtccccataagatcaccctacagtgaagtccatcaagtgataaggccttatcctgaacatagagcttctaacagaatgacagaatgctattgccccattctcactatgcagggataggcaagggtctgctatttgtggaaagcctcttatacaaaaggcagagaccagagccagccataaaacaagcaaaaaacaagtcaaaggaagcaaagacaatgcaaggagctgaagaaaacttcaaaaaaattaaaattagcatacttagctggaaaaggcaatgaaataggttctaccctagagccagcaaaaggaacacaggcctgccaacagttagattttagcccactgacagattttggacttctgacctttggaattagaagataataagtttatgttatttaaaaatatattaatatccttagaaacataagagaaaatattatctcaaaacaactatatactatataattacagtgatacgacattctggaaaagggtgcaactatggagacagtgaaaagatcagtggttgccaagggttagtggggagggaggtatgaataggcagagcacagaggatttttagtgcagtgacactactctatatgacacaataatggtgggaacatgtcattatccatttgtccaaatccacagactatataacaccaagagtgaatcctaatgtaaactatggactttgggtgataatgatatattgatatagatttattaattgttacaaatgttacaaatgcacctgtctggtgtaggatattgatagtgaggaaggctgtacatatgtgggggtcaggggaatatgggaactctctacttctccctcagtttttctgtgaacctaaaactgctttaaaaaataaagtctattaaaaaataagggtgtatccatcactgcaagcatttacgatgctatagacaagatagggcccttggaagataaaaatataatagcatacattaaaaaaataccaatagaaagggtggagataaagttgagtaaatatcccagaaagtaaaacaaatggacagaaatgggccaatggaagaaaagataagatctttagatcaattcaagaggcccaacatccaactaatgagaattcccaaagccggggaaaatggaggtgaaaattattgctgaaatcacacaagaacacttcctgaaattaaagtagaggagcctccaacttgacagggtccactgagtgccaagcactgtgaatccaaacaataacaaaatttgacacaaaggaacatcatcatgagatttcaaaacattggcaataaagagaagatcctaaaagcttccaaagggagaaacagaggtaaaatttcaatgatcttgaatcagaatatcttcaggcttctcaacagccacactagaagctaggcaacagtggcgcaactcctttgccatcttcgggaaaaattatttccactttaggattctatactcagccaatttttcattcaggtatgtgggtttaataaataaggcctctgaaattttgcctcagatgtgcttcttctcaggaagataaattaatatgatctccatcaatttgaggaagaaaaccaagaaagagaaatacacagtatgagaaacaggagaaatggaaaaagagttcccaggatgactgctgtaattatgtgatgtgtttaaccatatcaagaagatattgtttggggatgaatagtgatatgcgttaccaaaaaaagggaaaaaaaatatgaggcaatgattaactctagtgagaaaaagtttgtatgataaaggataaattaaacataattatagtgtactacctggctctgctgtgaactatatttacataattataataacagaaacactgtatcgtgatttaagtaaaaatggtgatatggttatactgggagtttggggtagggaaagagtagactatatagaggtggtccaagacagttaaatctttatcttccagggtagggaggcaaataattttctaaaatggtaaaatgaaaaacttcagtatagacatgctatgtagaaatatggaagtacataccagaagctgaagagatacaagagttagaaatggctgccgttatggagtatgaactggtgctctaattgatgttgataactatttacaagtattactctgataaaaaatttaaaaataagtaatttatataagagtttctggagccagatgagcaattcaagcatatcaacttagctgacactaagttgacacttagttaacactaagattgaatgccagggaagagtctcctggcaagatggcagaataacaaaataacttgtatgagtactggaaaggtgttggcaatttcctttccatgctcttgggccaaccaatccccctttgttcctgcaacagagagtctgcagcccagagagaggaagaggcttgcctatggttccattatgagtatggcagggcaaggaccagacctgttctgctaaaagctgtctttctagccttgaccctcaattcaggccttctgtgaccacagctctatcactgcttctcagcacttaagaaagaagccacagaggtttcacagccattcctctgaggtaggtcctattaatatcccattttgcaaataaggtcactgaggcacaggggggttaagtaagggttaaataaagggtgaaggtggggcaggcctttgtggataggatttctggatgcaacaacacatgaggtaaattttttgagttaaacttttcattttgaactaattataggttcacatgcagttgtaagaaagatcccatatatccttcacccagtttcccctaatggtaacatcttacaaaattatgttacaatgtcacaaccgggatattgacattttacagtcaagatacagaacaattccatcaccacaaggatccttctttttgcctgctcagcagaattttccgtaaatccatctaggttgttgtgtgtatccatagtttgttcctttttactgctgaggagtattccatgagatggaggtaccatagtttgtgtacccattcaccccattgactggttgcatggttttgggtgagacatgtaaccactcagtttcctccttcatagatctacattataatagtgcttacttcgtaggattgttgtgaggattaaatgagttcatctttggaaagattttataacaggactgtgcacacactaagtactatgtaagtgttggttaaataaaatataaataaatcagtccaggaagtcatcctggatttgaagaagccacaaaaatgtttgctttcctgatcagcagaaagattgcctgaatttagtctgaaagccagagagttaaataaaccctttcagaggggctgtgtctctagtctatttagggtaaattgaaagacacttgtaaacggtctctatttttcagctttcctttagtttagaagcaggaatgtttttgcctgctctttttcagcctcctaaacacggggtccctctccattttcttgtgcccaaagctactcctaacagtgcagcattgaaatcctctgctacactgctgatatttcaagccctagtcaaaacatcaaccttgtttatgtcaggcgttaccaaatgcccaaaacaaatgcttacgtcaaggaaagcagggtgaattcattgctgagctgtgctgtagatcagccttctggggcccgagatccttgataagggctccattctagatatgagctatgtggaggtgaaagtcatggctaccctggctccatggtgtgaagtgaaatgcaagacttatttaatgtaacactttcaaactccaaacccaatgtgagaatcaaaaatccctggggaagtttaagcagccccggtagtcccaggagagaggaaagaacagctcttaagtgtctggagtggtacttaaaccccctcctgctaagaaaggaccaagtatatggagacccagcttgcagaacgccccgcttcctgttcttgccccagccccctcctcaaattgagaatttaaactgggaatttgcaagctgagttgcacagggaaaacaccgggaccaaatctgggccaaaagggtttgtggtgcaaattacatttctctgttaattgtaatctgttaattacatgagaacaaagggtagagcaagcagagaccttgcccgccccccggccccccaccccaaggaaacccaatgcactgtgtgcacactggttcagtgagccgcacataatttcaagacacgaaggcgtacattgaaatacatcgctatatttagagataatggagtttttctttcttaaggcttgatataaactttgattacatagcatttctttaatttgctgctattcaagaaaaccctgggaacgccatggtgagcaatgcctagcttttatcatttgcatttttcatttgcatattttaattcctctgactacagttccacacctacatggacagtcccataagagggaagataatatttttcaggagtaataataccttttatggttggggagggggttaccagctgaatttagtcattcaaggggttggagaaaaaaaatgtgggtcttggaaaactttgggatggcttgaccccatgtcaggctcccgggccatgccccactaaagaatgggggccatgttgaaaagccccagatagccttcaacttctcccacttgtagagtttctgcagtgctacaggggaggaggtcaccatagagtttcagctgaacagtgctggaaggacaggaaggccctaaaaatcactttattctccctctttggggcagagatgagaccattgtgccaggagcaggccagaacccaggacttcctcagtcctcccattggactgggccatgctgctttgatccctgggatagaaccagagccttggacccacgctccagtttggggagatctgttcatggtttcctactttagtatgtgaaacaaacaaacaaaatacacctaaaatccacacaatcagaaaatcagtagtcttaatttcatctcctaatctaatgctgtgtaacaatatgggaaatctgtgggacaatctttagccttctctacagtatgttctctatagaaataagcaggactttttaaaaagatggctatattttagctatctgtttactgtggggagcctaatctgtttgccttccctaggaattctgggatgtcagatttgctacctggattcttgtttctttaagaacctgtaggtttcttgagggaaacatcaagactggtattttggttactgttacggtgggatacgagttttcagaacggggtttgagttgggaggactaggcaaagagggcagaaatgtttcctcagcaagagagggctgagcgccttgtgctttgtcttagaccctggtaaggaggtacagggctgtgtcactgagatgattgctactctaaatcctgaggaaatctctccaagtttatttattcaatcaatatttactgagcaccactttatgtattacgtgctagatagtggggtacagaggtggacaagacatctgctgcctctacttcatggagctgataacgtagtgggggagactgctgagttaacaggtaattatggtaaaccaaaagagccaggctgcattacggggctgtggctgccaccacagagaggccacattcccaacaactgactttggacgtgtcttagtccattctggctgctataacaaagtactatagattgggtggcttataaaaacagaaatatatttctcattgttctggagtcagggaagtctgagatcaggatgccagcatggttgatttgtggtgaggcttctcttctgggtcatagactgtttacttcccagtgtcctaacctggcagaagagcaaatgagctctctggggcttctttcatacaaacactaatctcgttcatgagggctccagcctcatgacctcatcacctatcgaaggtctcacctcctaatatcatcatgttggaggttagggtgtcagcaaagaaattttagggggacacaaaccttcagtcaataacaggtgccacataaatcctttacagaattttaaaacaaattaaagtgcataaaaagcggcccctaaacatcaaaagtaaaatgaaaacaaaaatcaaaataacaagaatctgtgtagagaactatttcaagtgactttaatacatagtaacttgactgagcatcgctaataggatttattataaggaaaaaaagaactgcaaaaaaaatcttaaattgtttttggtaatcatattgttggtagcagtgctagttttgttattctgagactgtcattcatgttgtgggaaaaattaaccgagtgtgctggtttcattggatggaagagattaaataaaaaccctgtagtcctgaatctgaattgaaagtgttagtatggattcataaattattttgtcttaaaaaaatattttctacctctgtctctgaaaaggcctagaaacaatggcaaacctattggcaaggatactgttagtgcccagatcttgatttctaaataccatttatcattaaaagaacaaaggttccttggagaagtggctgatttcaggtctggggcagaaaatgtaccagacaaccctggaactgcctgtcataccagaaagcaagggaagttgtcaaaaactactatcatagcaaaaggtcttaggacccaacctgtataaactctcattggccaaagatataacaatttgagcatcaacaagaataattactgaaaggattggagcagaacacatctgtctaaatctgtgagattctaatgatagtgaaaagttttaaaaattggtctcattggttcacatatttggaggatgctagggaacccaactccttattttaaaaacaggtaaataaatggaaagaaataaatacttctcctgcctttccaatataaaggtaaccaaatagttgatgacgagaagtctctttttatggaagtattccagctaataaatgagaaggaatgagaaaagtagaatatcaccattttgaaaccctaatgaaatgatggacattgtgctacaatccactgatgttattcctatttccccagttttacagatattcagttgtgagtgtgtattagtcacagctctccagagaaacagccaatataacatatactcatcccttggtatcaatgggggattaattccaggaaccccaacaggtaccaaaatccttgcatgttcatgtctgtgatataaaatggcatagtatttgcatataaactatgtacatcttctggtatactttgaatcacctcaagattacttacaatgcctcatacaatgtacatgctatataaatattgttatactgtattgtttttacttgtatcatttgtaattgtattgttatttttatcatttttttccaaatacttttgatccatggttggttgaatctgcagatgtggaatgtgactgtgtgtgtatgcgtgtgtgtgtgtgtgtgtgtgtgtgtgtgtagtacatatatccccacaatctgctgtttgtaaggcagagacccaggaaagctagtgggtgtagttcaaacacctgaaagccagagaactgacagtgtagattccagtccaggtcaaaaggcccaagaaccaagagtgtcaaagccaagagataattgatgttccagcgcaagcaatcaggcaagttaaacattcctccgcttttttgttctatgtgggccctaaatggattggatgatgcccacctacattagggagggccacttgttttgcttagcccaccaattcaaatgctaatctgtttcagaaacaccctcacagacccacccagaaatagtgtttaaccagatatctgggcatcccttagcccaatcatgattggctttttcactcattataattctctggagctgcaaccaggttgttgtgtgtattaattgtttgcttctttttattgctgagtagtattccagcatgtggatgtatcacagcttgtttaaccattcccactgaatgatatctgggctgattccaattttggctattataagtaaaacttctatgaacattcataaaccgatttttgtgagaacataggctttccttcccctagaataaatgtccaggagtgcaattgtttagttatatggcatttgcatacataaactacatatggtagtttagctttataagcaattgccaatctgttctccagaatagctatatcattttatattctaattgccatttacaagtgatccagtttatccacataattgccaacctagtgttgttccttttttaaaacaaaaatttaagagtttatttgagcaaacattgattcatgaatcaggtagcaccaaacagaaagtggttagggctctactgaaggagtggggagaatgttttacagggtaaacacagaagtaagccaaagaaaatatttgattggttacatgtgtatagttgccttgtttggtctatctcattgggaaatcccaagttagataattataggttagttggtggcttccaattgattgagcttaagtttcacttttctctgagatggacgttataagaaatagaccatgttaagttgtagttgtgtttgctaatcaagcaaggttaagatcactttccaggtctagatggttaattttctgtgtcaacttgactggatcacgagatggccagatatttggttaaacattatttctagttgtgtctgtagggctgtttccaggagaaattagcatgtgaatgagtagaccaaggaaatgaattgtctttgccagtgtgggtgggcatgatctaatccattgaggaccagaatagagcaaaaaaggtggaacgggtgagttcatgctgcctgactgctcgagctgagacgttgatctcctaccctcaatattcctggttctcagtccttcagaccgttctgctttgttccgttaaaaaaaaattttagccattctgataagtgtgtaaggtatcccatcgtggttacaacgtgcattcattgataactaacaatgttgagcatcttttcatgtgtttatttgccatctgtggattttcttcagtgaaatacatctttatgtcttttgcccattttctaattgaattgttttttactgtcaaagaacttgtatctagaatatataaggagttctcaaaactgtagttttcaaagaatttctccctgtctgtaacttgtttgatcattttcatagggtctttctcagagcaagattttttcattttgatgtagtctaatttatctagttttctttttatgggacatgcttttggagtaatggctaagaactccctgcctagtcctaaatcttgaagattttttcttgtgttgtttttttctgagttttatagttttacatttcacaattaattttatgatccattttgagttaatttttacattacctgtgagatttaggtcaacgtgggtttttttttttttttggcttatggatattgaattgcttcagcatcacttgctgaaagacaaaccttcctctgttgaattgcttttgcaattttgtcaaaaatcaaagggtggttctattatggttctttctatttctcagttcttcattctgttccactggtctatgtatctgtccctccactaatcctgagttgtcttaattactggagctataaactcaaccttaatattgggtagagtgataccttcaactttattcttttttgacaagattgttttagctaatttaaacctgtgccattccatgtaaattgtaaaataagcttgtatagatctacaagtaaaccttgctggtattttgataggaattatgctaaatctgtgtatcaattacataagaattgaaatctttattatcttgagtcttttaacccaagaatagggatgatttatctctccatttgtttaggtgttatttgatttccttcgtcaactttttgtaaattttggcatactgatgcgtgttttcttaaggttatacctaagtatttcattttctttggagcgattattaatggtattgtgttttgaattttggtttctacatatttattgttagtgtataaaagtgttattaaattttggggtatgttggtcttgtattctacacccttgctgaattgacttagtagatcttgaatatttttagtgatgctttggaattttctatagagatgatcatgtcatctgcaagtacaggaagttttatttcttcatttccaatctgtatacctttatttccttttcttgccttattacagttgctaggacttccagttctatgctgagtaaaagtgctgaaatctggaagacttgccttgttcctgaccttagggggaaagcacttattcttttaccattaaggagtaataaattatttcaggtatactaataatgatgtagttatgcttcagaagggattgataataccattttatactctataattctatatttccataatagaaagttcaaaaagttagagtgtagggagtgttattgactaaaagagacaggcagtatgagaaccttgtttgcactgattcaaatcaaataattttagtatggattcataaggaatcattgttaatttggttgtgatcatgacatgttagatgtgttttccaaaaagtccttatgagttagagctgcatactgaatctagattttcagactctcagtcaagtgctctttccccatctactgcctctcagcccacaccagccaaacagaatatctttaagtctggctgaagcttaaagaggtgggggtagggataggtctttggccataacaactcacaggaaactgtctgtgccctccagcatatcaactggctttgcaagcacccggcccagatgtgtcaggcctatggacacagaccgtctttatgaggcttgctcaatggctgtctgtgagcccagagttgcccagccacctcctggccaggggcatcctgggtggctgccaaaccaatgacagagttcacactctcaggcctttgctcctccttcatgttgactggaaagtctccatcttccacagcgtaagtggggacactgcaagcacagttgctggctggcagggctcaggccactcttcattgtatgcaagccatgagcattgagcacttattcagcaaacattcactaagaagtgactaggcgcccagaagctcaccaggtcagggggcggggctgaagaaagcataaggatccataagcacaagttggtacagaccccagccagatgttaggggagtggggaagagctggtaggagagagcctagaaggaaggacaggaatcaggcctgggcagagcatagagcgtgcagggaaagaaatctgggactagggagcaacctgggcaaagcctggagtgggtaacttgtggaagatggagcagttccttttgtccagagtggagagtaggtgtgtgagaaggggagtatcagcagatggagggaagcaggttgaagtcttgatagggaagaccttcaaggccagtgaagggctcttgagggaaaagtggtatttttgagcaaaagtagggtgggggaagcaaaatgatcacagtaatgaaagtgggattattttttactcccaaccatccctcatgaaaacattccaataacatctgttatcactgtgcattttccgacacgcaatttgaaatgctgccgtgattaatggggcccaacaaagtcatggggtgcatattctgagggaacttgtgaaagcagatgttttatgccaggttgtgtccatgtgtccctgctacagagctcctcactcatccacacaggagccatgctacaggaatagagtttacctactggagaagccacccttggcagtgcctgtagtccaggtctctgttggatgtgcctcagggcagagcctaggctatggcctgggaaacaggccatgaaaccaaatgttgcacactcactacacctaaggtgctttttgtctggtggagagaggaaggccaggcatagaattgctttcatatcaggacaaatgaaacaagtgtgaagtcataataaatcaggccaccattaggtagctcatttccttgaacatttattatgggccaggccctgagccaagcactttcacatacatcgtcttattggatcctccctgaaaccctgtggaataggccatattattagccccattttaaagagcaggaaaccaaggctcagacaaatgaaataacttggtagcccaagttcacacctggctactaggaagacaagacaggcttcaaatccaggactggttaacctcaaagcccacattctttccactctaacacatcttggagcctactttttttcttttcaacttcaaattttgaaatatagattcacaggaagttacaaagatactacagcatggtattgtgtacctttaacccagttttcctcagttgttacatgaaatgtaactatagtacaatatcaaaactaggaatttgatattggtacaatgtgtgtatagttctatgccatttgatcacatgtgtacattcctgtaaccatcaccacaatcaagataaagaactgttccatcaccacaaagatcttccgtgtgttacacctttaaacacacacagacacacaccctcaatcccaccatctctaacctctggcagctagtaatctgttctccatctctataatttttcatttcgagactgttatatagattgttttttacctcattcatcataatgcccttgagatccattcaagttgttgcatgtatcattaggtcatttctggttattgctgaatagtactccatggtttggatgtaccatagtttgtttaaccattcacacactgatggatagctgaggtcttttcagtttttgactactacaaataaatctgctatgaatatttgtgtatagttttgtgaaaataagtttttcattttttctgagataaatggccaggagagaaattgctgggttgtacagtagttgcatgcttaattttataagaaattgactcttttcaagagggactgtaccatttatgttcccaccaacaatgtataatccagtttttctgtatcatcttcagcgtttgttgttgtcaatattttttattttagccattcggataggtgtgcaatgatatctcattgtggtttttatttgcatttccttgatggctaatgaggttgtgcttatttgccatctgtggattatcttccacaaaatgtttcttcgtgtgttttgcctattttctgacaggagtttttattattattattatactcttgatttttgagagctctttatatatcctagatacaagtcttttgttgaatatatggtttgtaaatattttctcccagtctgtagcttgtcttttcaccctcttaacagtgcctttcaggagcaaagtagtttcggtgtgacccagttaatctattttttttttaatagattatgattttggtgtcaagtctaagaattcttcactcagccataggttccaaagatttttgcttatgttttcttctgaaaactttatactttgacatgttatatttaagtctgtgatccattttgagtttaaaaagtgtgacggttaggtcaaatttttttttttttttttttactgtgggtgtccacttgctccagtaccatttgttaaaaagactatccttcctccattaaattgcttttgcaactttgtcaaaaatctgttgggcgtatttgtgtgggtctatttatgaattctctgttctgtctcactgatctatatcagtgtctgttcctctgccctaaacacactatactgcttactttggttatgcaataggccttaacaccaagcagagaaattcttcttagtttatttttatttttcaaagttgttttaactattcgagttcctttgctttttcatataaatttaaggataatattgtctatatttacaaacaaatcctgctggaattttgataggaatggcattaaaactgtatttcaatatggggagaattgacatctttactatgttgcatcttttaatccctgaatatggtatgtctctccatttatttagatcttctttaatttctttcattagcattgtgtagttttcagcataaacatactgtgcttgtgttgttagatttacagctaaatatttccttctctcttttagagttattttaaatggtattgtgcttttaactatagtttctacatgcttgttgctagtatactgaagtaagattggctttcgtgtgttgatcttgtgttctgcaactttgatgaactctctcattacttgttttatacatacctcaagatttttaacatagattatcatgttatctacaagcaggaacagttttagttcttcctttctaatctattccagttatctccttttcttattgagctggctaggactttcagtgacatgttgagtaagagtggtactagcagacatccttgttttctttcaggctttagagggaaagtgttcagtcttttaccattaagtatgacattagttataggtattatgtagatgctcttcccctctgattagtctgcttggactgccattacagaatatcacagactggatggcttaaatgagagttgtggggtgataaagagatctctggtatcttgtcctcttcttataaagacatcagtcctgttgggttatgaacccactcttatggcctcatttaaccataattaccttgttaatggccctgtctccaaatacagccaaatttggggttaggactttaacataatgaatttgggcagggggacacacaattcagtctgtaacaccctctattcctaagttactgagaggtttttaaaattgtaaatggctgttggattttgccacatgcttttttgatttaatccatgtgatttttcttctttagcctgctgatatgatggagtacattgattgaaaatattgaaccagactttcatacctggaataaaccccaccttgtcatgctgtataaatctcttcatatattgctaatatatttttaaagaatgtttgtgtctatattcatgagttatattggtgtgtggttttcttttctgtactgtcttttcccagcttttgtattggataagactggcctcataaaatagatttgaaagtgttttatcttctattttctggaagaggctgtgtaaaattggtcttaattcttctttaaactttttctttttttgagacagagtctcactctgtcacccaggctggaatgcagtggtgtgatctcagctcactgcaacctccacctcccagattcaaatgattctcctgccccagcctcccaagtggctgagattataggcatgcaccaccatgcccacccaatttttttttttttttttagtagagatggggttttgccatgttggccaggctggtctcgaactcctgacctcaagtgattcacccccatagaactcccaaagtgctgggattacaggcataagccatcaccacccggccttctttaaacttttgatagatgttctaaccaaaccatctgagactggagatttctttctcacagttatacttttaaactatgattgcatttttaatggtcatatggctatttaaattattgttttcatattgagtaagttttggtagtttgtactttttgaagacttggtgcattttatctaagttgtcaaatgtatgtgtgtagagttgttcatagtactcccttgttattcttttggtgactgcagggtctgtagtgatagcccctgtttcaccccgatattggtaaatgtcttctctttttattgtcagtatcattagatgtttgtcaattttattgatcttttcagaaaaccagctttttgtttcaaagatttttgtcttgttttctgttttcagtttcattgacttctgttattatttcttccttctgcttgtgttggaatacttgttcttcttttttaggttcttaaaggaagagcctaaattaacgatttgagactttttattttctgtaatgtatgtattagtgttataaatttcattctagcactgctttagctgtgtctaaaaaatttcaatatgttgtgttttttttacttttattccattgtgtcacatgatacattctgtatgattttaattcttttaaatatgttgaggtttgttctatgttccaggatatggtctatcttggtgaatgtcccgcaggcacttgaagaaaatgccttttctgcttgttgggtgaagtgttctacaaatgtcaattaaatcctgttggttgatagtgttgttgagttagttcttctacatccttgctttttgtcttgttgttatatcaagggttgagagagtggcgttaaagtcttcaactgtaattgtggatttgtctgtttctccttttagctctatccgttttgcttcacatgcattgcagtgttgttgtttggtttgtatacatttatgattgcagtgtctttttggtagattaactgtttttttttttttttttttttttttagagggagactcgctctgtcccccaggctagagtacagtggcgcaatctcagctcactgcaacctccgcctcctgggttcaagcgattctcctgcctcagcctcctgagtagctgggattacaggcacatgccaccatacctggctactttttttgtattttttttttttttttttttttgagacggagtctcgctctgtcgcccaggccggactgcggactgcagtggcgcaatctcggctcactgcaagctccgcttcccgggttcacgccattctcctgcctcagcctcctgagtagctgggactacaggcgcccgccaccgcgcccggctaattttttgtatttttagtagagacggggtttcaccatgttggccaggctggtctcaaactcctgacctcaggtgatccacctgcctcagcctcccaaagtgctgggactgcaggcgtgagccaccacacctggcctagattgactctttcattattatataatgttcatctctgtctgtagtaattttctttgcccttaagtctactttatctgatattaacatagatactcctgctcttctttgataaatgcttgcaggatatttttctaatccgtttattttcaacctgctcatattgttatatgaaaatgagtttcctgtagacaacaatagttgggttatgcttttcaaaccactttgcctgtcatttttaaattctattttgaaatatctatagtgtttttgagaatatccatttgaatagttttttagtggttgttctaggtgttacattatgcatacataactttatcacagtctactggtgttacacttaattagtttaaatgaaatgtagaaatcttaccttcatttatgtccttttgtcccaccccttactttatagtataattgtaaaaagtattttctctgcatacatttagaattcatcagactatgtcataatttttgctttgatcatctaacataattagaaaacttaggagaaaaatggtctactatttttatatgtgttattactctttctgctgttctttattcctgatgctctaaggtttttaattttgtcacttactttttatttagagaacttcctttagccattttttaagagtagatgtgctggtgacatacttttagcttttttgtttttttttttttcatctgagaatgtgttcatttcacatttattcctgaaggatatttttctctgagtatgggattctaggctgacagttcttttatttcagcactagagaaatgttgccccactaccttctggcctccatgatttctgaagagaaatacaatgtcattcaaattagtttacattgctatggactgaatatttgtgccacctaaatacatattttgaagcttaatccccaatgtggtggtatttggaggtaagggctttgggaggtatttaggtcatgagggtgggaccatcatgaataagattagtaacctttataagaagagatatcagagcacttgctgtctctctcttccatgtgaagatacagcaaggtgatggccatttacaaaccaagaagaggacactcatgagaaccctactatgctggcatcccatcctcagacttctagctttaataactgtaagaaataaatttctgttgcttaagccacctagtttaggatattctctcatagcagcctgaactgactgatacatacttgtatagataatgagtcatttctttttagttgtttttaagacttttttctttgtttttactttcgtgaaattctactatgatgtgtctcagaatggattttattcaattcatcctgcttgggttttgcctaactctttgaatctgtagggttatgtcttacaccaaacttcggagcttttcatccatatttttttcccaataattttctctctctcctctcctctccttctcagattttgatgatataaaatatcctgaagttcactggttctttccactgtcctctccattcttctgttgagcctatctactgagttttttatttcagttattgtattttgcagttctaagaatttaatttggttatttgttggtcttttaattctttattgggactttctatttttttcatttgtttcaagagcattcataattgctcactgaaccattttttacaatagctgctataaaatcctcatcagataattctaacacctctgtcatctaggtgttgacaattattgtcttttctcattcaagttgtgattttcctggttctaagcatgacaagtgatttttgaacatatcctggacatttggggtatcatgttgagattttgtatcctatttaatctgcgtttatgtaggcagttcaccctgttgaggtatagtatgcaggttcaggtagtggtagatgttctgctccccactaataccctgctattaccacccctgcaaaggcagattgctaaattgcaccaccttgcattggcttgctgccaacaggtgggggtggctaggctctgctgacactatcttatcaggatcagtggagtggcaactagcacaacctctcgctatcttgttccaccttcttgctatcatgatggggacaaaaattcagctccccacctgatcttgctgacattgtaggatggggggaaggaagtttttcctttgttgtttagttagagaagggtggatcatataaaaaaagtttctgttttgctaggtcattttcttcctaatcctttggatagagaaagaaaatttttttttgtattgtgtttgttttcttgcttgccttataaaaatttgtgcctgttgactattccattttgaaagtatctgtagtgtcatgtatgggatatatgaaaggaaataagaaaactcagaaaactctctgccatgtcattcctcaagtatcaagttctctagacagtcttccttcttctctctaccttatggagtcttcctacgtttgtttgttgtgttatatccaggcttactagttgtcacagagcggacctggaaggaatggggctattctatcaatgatggctagtcctgcaagtccctacattttattaaagtcatagtagcaataatattgaatgcttgccataggccaagtactctctcttccaaaagctttctgtatatcattttttcatccatataacaattctgtgaagcaggtactgatattcccatttgaaatatgagaaaactgagtctcagaattgaaatgacttccctaaggtcacacaactagtagaagactcacagctatctgacttctgagccctgtaattacccccaatgatgaaggattctttgatctaagaataagcaaactgcaatgggaatagagaggaaagtgagatgaataattcctaggaaatgaggaacagtcagcaaagggaatgggcacaaatatttcttgagcatctatgctagaccaaaccctgtgctaatcagtttatacgtcatgccatcagggaaggcttcccagaggagaggtattgcattgggccttaaaacataagtggaaatcccataagcagagaaggaagtgaaagaaattataggtagatgaaacagcatgagccaaagtcagaaagtctggaaagaacacaggaaattcagggaatggtgaccaccctggggaggcttgaaacatggagagatgtggttggggaagaaggcaggaccaaatcatggagggtcctgcttgccaggcacaggagcctggactgagtgcatctggctaatggaaagcaaggacaatgcacgttgatcagatagaaggtcaagatggtttgtgggcagctacatgcctctcttcttgcctataacttctgggaagtgcaattttgtttaagttgaagaatttagtccttaaatacataacattaaagccatgactatatctgataatttcagattaacaaaaaagaaagcccaatccttggggaaggtgcaattcctggggacaggaatggggaaaagtgctgcaaagccaactatggggaaggctggacctctgggttactcaactcagagccccacccaagaatgactccagctcagcaccagctcaaaccatcacacactgtcataccaagggaaagggagaagggaattccaaagaactcaaagcccctgcccaagccaaaaacttctcatcaatccagaaagtgagtgagctgctctcacctctgcctagaatcttctgcccctctggccatgggacatatcttctcttgcagcccaacttagtgagtgtagcaggggctcaaagtagattccttgggtgatttattggctgttacctctcaaactggcagcatgcattcccatatgcagcatatttctacataattgaaatccttcccacaagcctgtcaggcagggtttccagccccactctacacatcaggaagtcaaagctgctcagtaggaaggggctagactggatgtagctgagcctctgactcctggattatgtgcccacacaacagaacttccagtctatttcctactggctctccattggctctcacctcacctgcccatgatgtcccagcctctgcttttgttccctccaaacatccttttaagagcccctttggactaatcagaagaggtaactggtttccattagtgccttacctgaccagcttatagcctctggatctctcctcattctctgggtctccccatcttcactgccaccggagttgtttggtgccatgttcgctggtctcttgggtgattcctgcatttggtccatgataggacctcatctaaagtgccttattattgttcagcattagggtattccttaatgctgagtcttcagaaggccagcccagtctgcaaacagaccctggcagccatcctgcagtcacaagtatctagctgtggtatagtggaacaaatctgcgttttggtatcagacggacctgggtttgaattaaagcctggcaccttacttgctctgggaccttagtcaatcactgtacccttatccctctgagtatgattctcaaatagagccacaaattgcaaggcatcatggaactaggtccctactgctctgagcccccccactttttggagccattcggtagagagagcagctgatggaagaagcaactacggccaaagaggtttcgttctacacgcacattcagaaagcacttgtgaggaaggacatgtgcctagctggtggaacactccagcctgtgctttgggcactatgaagtgagtttgatcaaatgcttaggtagcaccatgcattgtgcccatccattcctggtttcaagtaccatgaatggtgcaatatccagatcaccctcagatctccagggtaaaggcacagagatcctgtgccacccctggagggctgggtaagagtaggcagggataagtaggtagggaggagctgttgccagggacacctttctgggaaggagagcaaactgaaaacagtggtgggggttggaagggctgcagctcctcagaaatgaggcctactggggctccagacatggaaggcaaggtgagtcctgttgcaggccctcaccatccccctatgtagaatctcaccagacccctccttatgaaggcagccatcttctcccagagtcgaagaggaagaaaatccatcattctaagagagaagcagaaatttcctgaaagagcagaaatgaaatatggaagggaagagattttagcagatccgatatgggctttttaatctgctagctggtatctctaaactaatttccaaacaaagagaaaaaagagccagctgggcctccagggaccctcatattttctagctggaaagtgcatcaggttgggtgagagtaagcagacccatgcctgcagaatcctactctgagtgaggcacaagaggcacaggctggtggggaagagcagcataggggccaggagacaaagagggaggccatagtcagcaatgggagcaccttgctccttgtcttgaagagctgtttattttctaaatactagcattccatcttttatgggtcacacacacacacacacacacacacacacacacacacacacacacaggcatattcaacaaggaggggtctgacttccagtggcaggacagaatgggccagagacctggatgaggtgactgaagactggaagtgaaccatggctcccttgtctccctcgtctgccctgattaggtgtatgacttcataggacccttgccctcagttttgaattctgcccagccaatcccccagggatttagtaaggagcatgatacagtgacacatttggaaaactgaaagccctgtgcccatggcatacaggaatctgacaagagcaaccagcaaagtatggctcaattccacataaggaaggtgctgccctctctcctcctaccagtgcaacccacagactagccgtgttacctgtaggatcgctgaggatccactccaatacttctttgcctgaaagtcttgcccctctagcttgtgccacacattgcagtcaaagtgtgccccacacatggtgctaaccatgtcacttctctctccaaacccttccatgagttcccattgtcctcaagataaattccaagtccctcagaatggccaagaaggaccctaaacttgattaaaaattggtcgtagaagccgtcatatgaatgtcttctgaatttgctttcaaacttgtagtgagtgttccactgaatatcttaactctaacaccacaagtgctcactcatgtggaagctaaaaaaaagttgatctcatagaagtaaaaagtagaacagagaatagtaaaggctgggaagggtagaaggaagtgggggataggaagagatttgttaaaggatacaaaattacagctagataggaggaatacgttctagtgttctataccactgtagttaacaagaatatattatacagtttcaaatagctaggagaagaatattgaatgttcccaacacaaagaaatgatgtttgagatgatgaatatgctaattaccttgatctgatcgctctacattatatgtatcaaaacgtcactatgtacttcatgaatagatacaattattatgtcaattaaacaactaaaaaatttaaaagttttaaaataattaaaatataaaaataaataaaatgaaaaaaatccccagttaaaaaaaaattttctttctgaatttggggccaatggaagaaaaaacaggcctctttgaagataaaaatgtttccattttttctgatgatgaaaactctggagtcctacatgattttttctttttatcctctggctgccagtaaactgctggataaacgttatttttagtccccaaatcatgttaacccttggaattatcaagatttttctcctctaattctttatttttgtcttagtattcctattttattaacataggacaatgcccactctaccacaaagtctatatagagtgatggtagaaatatacaaacaatattttcagtaaagttttctagaacaatactcataacccagctgtgtggttggatcaaagaacactctctctgtgggataccaaatagtatgggagctcagagaggaactgtagggagccccgtagaagagatggccagctgactgagccattgtgcaggcctgaagcattggtcaaggggccaatattctccctctttctttcctcaattcaaaaaaaaggagagaacatgtccaaggtcatggcccaaggtaatgtcagaattggaaggaatctctccttagttaccactctgtctcaccatagcccttctgctctccagttttacaaatggggaaattgatgctcagaaaaagctagtagcctttgatacctctccttgtccacagaattcttgaagccaccaagaatgcctgacttcttgacataaccccgttattaaggtgggaggtgggacttgactccagaggtggggcttggagactggaccagattgaggactagctaaaacagggccaaccagtgcagaagcagctttcaatcagacatgctcaccagtgtgctatgtcaatttattgttgccgcagcaacacccaggagttactgcccctttccatggcaatgactcaatgacccaaaagttactacttcctccatagaaatttctgcataaactccctcttaatctgcatgcaactaaaattgggtataaatattactgcaaaaatgccctgagctgctactctctgcctaaggggtagccctgctctgagggagcagtcgctgaagctgtaacactgcctcttcaataaagctgttttcttctatctctggcttgaccttgaattctttccttggcaaagccaagagccctcgcaggccgccctttgcctgccctgcatcattaaggcactgatgtgtatactgtaagggaggaaggagaaaatacattctattctgtagcaaattgtgtactggccttcactctgtaaatgaagacgtggtttaagctacaaaatagccaaataggtggcctagtgaggttgtttatagcagccagatacaactggggattctgggaaagaatcaacaacagatttaaggccttcagtttaaaccacttggtagtcactacctgagtcagtcctccagtctagcttggtgctgagtagaaggcattgcagattgcccttccatctgcacctgagtccacagcatcccatacttatctaatcagctagctgcctgtgcactcctaacaatggcaccctatgcagtgcagtcagctgtgccaatacccatctataccagtgctgggtgacaaggcctcacaagtgtagtctaaacacttcccggggttctaggctggagctgtggcaagtggaatgaatcctctgcaatgtccttgtcctaatacttgctgaagagtatttatgtcccatggaagggcccaagcagaaggaaagataccaccaaaactgggaatggactctgccactggaaaatggagactctgtaattactccattataattcaagaaataaaatatatttccggtgattaactgggtctatttatagaccatgaggcctgaactatgatatttatagaatgtcatcgcatttagcagtaatagcacaattacatgtttatgaagtaatggttttgcaatttttcctagaattctctgacatttggatctggaaattttacattttaacaagcaagaacagcagctatttatttaagggtgaacagcagaaactgtcttctctgttaactcttttcactccaaaagcctgtgaactccctaattgattttgcttttacataagaaacaagatgatgtacagcaaataatatacctatttttgtagagctctggtttctttcttaaatggtgcctttcattgcttggaattctcatatcctgaatcttccttcttgggatttagtgtgatatggttttcctttttccataatgatctaagtcaggctaaaaggctaagacagatgtgtttaatatccaaaataatatagtggaaatgaaatgagacaccatgccaatgagtccccctttgctctaactcataatttaaaacttggtgttttaatggaaaaagtggaaattctctttgggttattggcaacagcagtaaattagcatggccagttgggtgtctctggaacaagtgctagaaacactctgtaagactcaagccagagtgctgaccctcaaatccctttatcatctaattcctctggtagccactttcccatgcagctaccaaaccataactcacaggcccgggcagtggacacagcctttggcaatggaagatgggtctgcaatgacttgggactgctggtatattggtagcatttgccaatttccatggtgtaaatagtcacatcatgactgatttcaaactaccaacattctgtcaacagtctccagaatttctgaaaatttaatgaacatctttgagaaccagtatggaccagctccagcataccactgcctagggccaaatgatgaaatggaacctctaccaaactgggaggcaggagttctgggtccaggaacagttttactggaactgaattcattgggtaatccctcatatttcctactctgggcctgagtttctccagctgtcaaaagatgaatatagtatttgctctgcctgcctcaaaggcattgggatgtcaagagccaatagcatggccaggcgtagtggctcaagactgtaattccagctctttgggaggctgaggcgggtggatcactcgaggtcaggaattcgaaaccagcccagccaacatggtgaaacctagtctctactaataatacaaaaattagccaggtgtggtggtgtatgcctgtaatcccagctcctcaggaggctgaggcaggagaatctctttaagccgggaggcggaggttgtagtgggctgagattgcaccactacactctagcatgggcaacagagtgaaactccatctaaaaagaaaaagccattggcagccagatgtggtggtaaacgcttgtaattccagctactcgggtggctgaggtgggaggaccacttctgtccaagaatttgagaccagctcaggcaacatagcaagacccccatctcaaaaaaaaaaaaaaaaaaaaaaaaaaaaaaaaaggaaagaaaggaaaaaagagccaatggccagggaagtgcttagaaaacatgggagcaccttcttcccttctccccagctcctcactgggtgcccccaacacctcttgctgtcatttcttaagcttgcccacatttgtaggtggcaaattgcatcactctcttgccagccaaacttttgtgacacttgctgcttgttccaatatttaaaatatgaatattctggggagcaaacacaagccgcctcaacaatggaggcctcagaacacacttgatgtttggaacaattgtctctgatcatactggatcatacctctggaggggtgcgggagtcaaatgttcagtttccttggcctttccccacatcacctaaagcagaacactgtggacctcacagccgaatttttggtaactcacccactgttccagtctgttgtcatgctgctaataaagacatacccaagactgggtaatttataaaggaaagaggtttaatggactcacagttccacatggctagggaggcctcacaatcatggcggaaggcaaatgaggagcaaagtcacgtcttacatggtggcaggcaagagagcttgtgcaggggaactcctgtttatataaccatcagatcttgtgagacttattccctaccacaagaacagtatgagggaaactgctcacccctgtgattcaattatctccacctgtccccacccttgatatgtggggattattacaattcagggtgagattcagatggggacagagccaaaccgtattattccacccctggcccctcccaaatctcatgtcttcacatttcaaaaccaatcatgccttcccaacagttctccaaagtcttaactcattttagcatcaactcaaaggtccacagtccaaagtctcatctaaggcaatgcaggtcccttccgcctatgagcctgtaaaatcaaaagcaagctagttacctcctagaaacaatggggatataggcattgggtaaattcaggcattccatgggagaaattggccaaaactaaggggctactggccccatgcaagttcaaattccaatgaggcagtaaataaatcttaaagctccaaaattatctcctttgactccatgtctcacatccaggtcacactgatgaagaggtgggttcccatggtcttgggcagctctgcccctgtggctttgcagggtatagcccccctcccagctgctttcacgggctggcattgtctgcggcttttccaggtgcatggtgcaagctgtcagtggagctaccattgtggggtctagaatatggtggccctcttctcacagctccactaggccatgccccagtaaagactctgtatgggggctctgaccccacatttccattccatactgccctagtggaggttctccatgagggctctgcccctgcagcaaacttttgcctgggcatccaggtatttctatacatcccctgaaatctaaatggaggttcccaaacctcaattcttgacttctgtgcacctgcaggctcaacaccatgtggaagctgccaaggcttggggcttgcacctcctgaagccacagctggagttgtaccttggtccctttcaaccatggctagagtggctgggatgcagggcaccaaggccagaggctgcacacagcagggggtccctggacctggcccaggaaataatttttccctcctaggccttagggcctgtgatgagagtggctgccactaaagtctctgacatgccctggagacatttttcccattgtcttggctgttagcatttggctccttgttacttatgcacatttctgcagctggcttgaatttctcccccagaaaatgagtttttcttttttactgcatggtcaggctgcaaatttttcgaacgtttatgctctgcttcctcttgtacactttgccccttagaaatttcttccgccagatatcctaaatcatctctctcaagttaaaagttccacagacatctagggcagggataaaatgctgccagtctctttacatagcaagattgacttgtactccggttcccagcgagtttctcatctccatcagagaccacctcaacctggacttcattgtccatatcactatcagcattttggtcaaagccattcaacaagtctctaggaaattccaaactttcccacattttcatgtcctattttgagccctctgaactgttccaacctctgccttttacccagttccaaaatcgcttccacatttttgggtatctttacagcagcacatttgggcggggacacagcccaaccatatcacttgccaattcacttggcctttgcccaggaatgaatatatgcatcccaccaatatcacctccttatgaggagaactggggttttttaaatggtggaactttctgagtcactggagagattctctggcccacgggctgaatgctgccaacatctgttatggggcagtcctttctctttgtagcactttactggtcctcacctgaggactgatgatggtgctgacagactgccctctacctaccatctacttcctctccttggcactgggagttggctactggacatgtcctccaggagattccacaggcacctctcacttagcaagcctccctgagacctgtaccacattcactgctcatcatctcagttaatggccccttatctggcctgttacccaagtcatccttgacctttccgtctccctcatttctcacagccaagcagtcactgagtactgtccattctgcttctccatgtctggtatctgtctcttgctttccaggcctcctgcctctgcagtagtccaggccatcccctcatttctggcctacaataaactcctgactggtagcctgtcagtggtctctctccttgcaatccattgtccatgtttcatgacatgaccattctaaattgaacatacaatcgtgttactccctgtcttcacactcttctggggctttccactgctctcattctccctgagcacctgcatccagtcctatggtttcaatgagcatttctgtactccctgatggctctcacacccttatctccagctctaagcatctagatgtatatgaccagtcatcccctagacatcttctctggatgctccacagattcctcaaaccaagttatcccaaattgaactcatcatctcccttccccttccttagtcctgtctctttcccagtgctccctatcttagcatgagataacaacacaccggccacccagtgggtcaagccagaaagctgaaagccattgttgactcctcttcttccctcatttggcattttccagtctatggcccagatatgtccagaatctacccacttgtctccacctccactgctatcacgccactccaagtcatcatcatttttgcctggattattgctagatctccccatctctcattctatcctctttgtagaagttttatcctcctaaaacacagatcaaatgctacttttgcttaaaaaaagtttaagagtattccattacctacatgataaaggaatgtagcataccttaactccattctttataacaacccaggaaagtagctattatcccaggaaactgatttgcagggaggaaacaatagccaagtcagggtgtgaattcagctctgcttggcattaaagcccatactctttacccatagcacaggggttgagagcagtgtgcatgtgagtgaggtttgtaaaagcaatgcaagctcttccttaaaatgcacccaatctacctcctccccctctgacacaaacagctcttccagcttggacagtcacaaacttcaagactggggaggctatttgtctgctgacatgtcctccttgcagcctgtttccagctcttggtaatattgaggcatgaactcttcataatgcaacgtgagtgcatgtacagaaagtgcagtcagagagataacccctcttggcctcactaaccaaatggaaagatgattggttccctgcttccttctctccctgggttgttggaacagtcaaggataaagtggacatggacatgtttcgcaaaccatgaaatgctttagacctgggtatgtcggtttattaggcagaaccttcttgttttcctgttagcactgggtaaacaaggagtgccctacagccagagaggcagagacagtggagcagtgcaagtctccagttgtcccttgtcacctgacgtttgtcagcttggcctatgggcatggtgagctaattctctaggtgctttctgcctaagaccacttccctgatgcacactccaggggagcagtgggtgcctctggccctgacacctgattgttcccaggtagatgcagctctgaagcctcagagaaggatgagcttgacttgaattctgatgctggctttgctctgaccagcatgcaacctgaactacttagccagagtctcagccttacccataaaatagatataattattattttgacagagggtgagttttggcttcagattaaataacttaatctaatacacaatgactaggagctcactcggttagccacggagccaggtaataataaccatcagcattgattgagtgcctcttctgcgtcagctgctttatgtctcctcaccagggctagaaggaaggcactactgatttcccatgttatatatggaaaagaaaatcaagactctgggaggtgaagtgacttacccaaagtcacacagtgagcaaggggccagagcctccatgcctcagagcctgtttttgctttcatgcagccctatggggccagaggagataccaactgaccatgggtcacagctagcatggctaccttgccagctgagggaagaagagcatagcatccccacagcaagcccatctgtaacccaatggaacaagccaagtgatctctcaactccttttaacactatgggaaaagggacagacagacctcaggatggagtcttgccatcgccttctcctgtggccccacacttagggatccatgtggtgacctccttagtcatagctaaaaagacttcaaggcagctcgtccccagtcttgctcctggctgctgcctggcagagccgatgtccaacttggtgttaatgattaacgcacagcagtgggatcgcagagttgccgagagtcctgtgtccaagaatgaaccgcattgctaaatcagtgaagacagttgccaaggtaacccccatgtaatctatttaaccggctccccaaacaccaatcaaggtcagataacgcactagagcaccatatgaacacactcagacagaatcaagctttgtagcgagacagcagggaaggaagaaacctcattaggaagaaggaagaaaagcaccctaaatttcattttgaaaagtgttaattgggaatgcagcaggcttgggtgggggcagagcccaccatttggagcatgtcctggccacagaggaagtcactgggggccatttgttaagagctgccacagtctttccactcaggattaaaacaaaaggtgccagtggactaaattattcatttcattgagtgtttattaatgaaaaggttagtatttacattttagcctaacagggtgttttttgctccatttaaggacccctttccctaactcgaccattcaaccagtagcctcctccccagcacttcccaatagtcttaaatttcttacatgactctcaggagcaattgaaattgcatttcctctcccctcaccctgccagcctctctagagagtggccaggagaaaaagaccactttgtagaattgctgtctcatgccatctcatttcctgctcctagggtgttcataaaaacggtcctgggcaggaggcatggtgttggggagaggtaaggcatggggtggggctggctcccttgtctccagaggagactcccaacagcaggccacagtcatgccagtcagccctgtcctgtgctggcattgggctacaaagaattaaagtgaattgcctcaaagggcactcctgaatcaaatcttcaggtgtcctttcaccatctttgggctgtctggggcctattatggcactggagtgcctattttccaatctccattcagtacatcatggtggccttgtctcccacagtcgccaacacggtgctgagcccatttcctgagggtctcaggaaatggtactgaattaaatggtccacttcctcacagagcacactctgagacctggatttctgctctctggcccttagtgcatctccccacttctagtccttccctgtaggagacagaagcatctagaccactagccatgggagtagttgatgggcatgttgatcacttcctctgaagaaacatttttctttctttctttcttttttccacagaagcaatgcccagcctagatttgccaaatctgtgtcttggaccctttttttcaagtatgattaacctgaggaactccatgtgggggttctgagagataaaagagctctcaaccctaatggttttatcagaaaatgagcagttcaagcctggatttgaacccatccagtgaatgctcatgtcactcacagttcatgaactgaaatattcgaggtggaataattgtgctttatgaaaacatgggttgtaaccctgggtcctctgagtcaccatttctccatctgttttcagtgcaggaaaagtgatcacagggacacatgacagcctggtgacggaatatttgtttcacttggggattgtccgcaaatgcttcagaagacccctcaactggggatgcaaatatggcagccagggcattgtgctgaacagggacagggagattaaaagtgaggggaattttacaactccacaaacatatatatgcattcaagatcctgggcaaatagttttcaaggaggttgtgtttcaacaaaagctgatatataattggctatttccgacttggccaatgggtgtcactttcaaagtccactgcatattttgtaatggctgcaattgtacttaacatgcactgacattgggaacggttgttctcatcattcctgcctcagtatcagcttgctaagcactaaagacctttgcaaagacatgcatgtggaagccttcctgtccccaccaagttgctctgtgattagcaggcaaatcactctcctcaaagcttctcagatcaaggtttgaagggtgggtttttgtggaattgcttctaggatggggaggagcacagcagctatctttcagtaagactcacagggagttgctgctgcctggttggagagaaaggtgtgaagggcttctgacttcttagcctgccatccttctttcccaagagcctctctgcttccttcctccccagcgaaggcaaagcttcagaactgggggtgacaggcagggaaagggagatgagcgcttgggtggactggtgccctacttccctctcttctcttacctatatctgctctctctccccccaccaccagactccttatataaaagagcctcacttgggaaggctccagaggagtgccaaatgtccatcaacagataactggataaacaaaatgtggtgtatccatacatggaatactattcagtcttaaaaaggaaggacattcctgacatatgctacaccatggatgatgcttgcggacattatgctaagtgaaatgagccagtcacaaagggataaatcctgtgtgatttcactcacaggaggtccaaagggctgtcaaattcatagagaaggaaagtagaatgatgggtgccatgggctggggaacaggggatggggagttagtgtttaatggggacagaatttcggtttggaaagatgaagatttctggtgatggatggtggtgatggttgcacaacaacgtgaaggcacttatgccactgacctgtatgccaaaaaaatggctaaaaatattaggttggtgcaaaagtaattgcggtttttgccatttttttttttttttttaaagtaactgcaaagatcacaatgacttttgcaccatcctaatagtaaaatgttatgtatgttttaccacaataaaccattttaaagaaagagctccatttggacctgcctgcaggcaagaaggagggactcacaaatcaaatcagatttaggtcaacctcccacaacactcacttcatctagggaccacttttttttctgaaagcactttgaacagggccccagacacacttctacaatagtgtagcagtttcaatactttaggggctgggaaaagtggtgatgcccagatgagaggtgcataagtgtgctcctcgtcacagattagaaacaaaaacaagcaacaaggctgcaatggagaagctttgctgttcctttggtctgctcttcccatccagaagagcagaggcagtaaggaatgggggctcaccatagaggaattactgaagcctgagctggaaggaccctagacaccatctagcccaggctcctctccaaacagataagcaagccaagatcatgcccaagatcacagataagagagcttccttgggtaagggagcccttacttgagcatttcagccatgtcagacttcactggacagtctgtagctagaaaagatcagattctggaccaggagataccacttttaggcatatggagtctagctctcttgaaacagaaaccccctttaccaaagccaggaaagccctttttcctcattaacaaaacttcagaggcaggctggcattggtgaaaagcaggctgagtgttccattttacagatgaagaaactgaggatcagtgagggaaggtgattgcccaaggtcacaactagtaagcaacagagaaaggactagaacctcctgaatcaagcactctggttttctgcccactgtggtaccatcctcccagcccagtcagctagaggagaccatttctaaagtgctaatcatgccaggcactgggcgtatgaagggctttatatgtgtttaatcctcacaatgatactggggagatgggtgctgggattaggctgattttatacaagagaatgtggcagctcagagacgttaggtgacttgcctaagtcaccttcaaggtgacagccatgaagtggaaaaccagaattccaactccagacttcagaacacatattcttaaccatgaaattaggcagcctctccagagttctttacagacatgtttccttcagtattgtgcgtctttaagaatgtagaattgaggcctagtcctgtatgttgtgcctgtccccactcccagtttatcatagagatcaagatcaaggaggccttagaaagcaaggtttagaagtcagaaaagcagagaggccaaagggtgcagattcctggatctctccaaagttaataccaaacatgcatttatttgataggcactcaggaccccttactcatttttttcactttgctattggtatttttaaaaatttagatatagttcacatattacaacatttacctttggaagtgtacaagttttagtatattaataaagttgtacaaccactatattctagaacatttccatcacccccaagagaaacccttatacctattagcagacatttcccatttcctctcctctagccactaatctgctttccatctctatggatttgcctattgtgtacatttcatataaatggaatcatacaataggtaatcgttgtgactggcttcttttattaaatatattttaggatcatccattttgtagcatgcatcagtagttaattctttttatggctgaatgatattctatcatatagacatattattttatctactcatctattggaaatttttttgctgttatacataacactgctgtgaacatttgcatacacatttatgcatggatgtattcccaattcttttggctatatacctaggaatggaatttctgggtcatatgataaagtccatgtttaacttcttgaggaactttcagactgttttccaatgggactgcatcattttacatttccaccagcagtatatgagggtttcaaattcttcacattttcacaacacttgttgttttccttttttaaaattatagccatcttagtgggtgtgaagtgttatctcattgtggttttgatttgcatttgcatttcccgagtaattagtgatattgaccaccttttcatgtgctcactggccatgtatatatcttctttggagagatgactattcagatattttgcctatttttaattgagtcatgtgtctttttattgctgagttgtaagagttctttattctggatacaagtcccctatcgaatatgtaatttgcaaatattttctcccactaactgacccttggttcataaagttccagaacattagagctgggagaactgctggaataacctggcccagagattcccaaatttcaggctccacatgctcacatctgtactaatttttaatttaaaatattctttaggtcaacccactacttttgcttcaacttattttaaaaggaaacttttcattattgtgtaaaagaagcaccaatattacttgccacaaaaatgaacacgacgaacactaaaccatgatattaaatcccagtgagaacccagtgtctgtgggtgtccagggcctgaaccctgctttctctgtggtaaaaaaggagatgagcaaagtttagaagagtgttccagacaagtagcacccacctgaggcagagggtttgctgtctcctgaggactgaaaagcagttgacctgagactgacattcttactataggtctggttgactattgcttaactagagactattgcttctatgcaacctaaaatccatcttcagcatgcatccccggttttgagaaacccttctcttatctaaccttagtgtaccttcagggaaacaaccaaggtgaatctgggacttgtctgaaggcacagtgtgagccagacaatttccaaggcaataaagagcacagatgtaccagacaggcccctttctatgttggtatggcaaatatcatgaaagacagtcactgaagtccccttgactcaactcccaccatcatatgagttagtgcaagacttcaagcaaacaaaatgtaaatggataactaaacatattttatattaaccataagtatccaaggcccttattgcaataggtgtggggggttttggtggttaatttgttctccagccctcagttgtgggaggcagacattacaggacttgtggcgtacagaactgggcagtacagatctttagcctggtcggtgaggacattcttgtcctgaagcaaagcagagataatggatcttggagatgctgcctcctggctggaagtcactccccagtggacatgcagatggtttaagccaaacacacagggtaggggaagattctaacaatgaattccaacccttctttattgcttttcttgtggatgctccagatgattctgaagcccagtctagggcaccccaatgcccggtgctatccacctgcagctcccttttggcacaggcaaatcctctcatggaatcagccatttctcagatcttaaagttgaaggatttgcccattgctgttcctagggcatggagggaagacccagggactgcagaggcccttgcttctccagcaggagcaagtagcctcaccaacagggagccctttcagtcctggagctcttgtgtccttactgcaggtacagtttcttctatctgaacccaatggcctgttagattaatttatttgtattttctgaagtaaaataatgtgacaattgagacaaagtacttgatattttttcttgctagtgctcccttccatctcttgatacccaatacctgaatgtcccttcaagaataccagctgctgtcacggcaaccaggtggaggcaggacataaactgctggcaaaagcaatttgctcttagaaatatttttagtcaaaagcagtctctccccaatctgctttggaaaataggtgaaaacaaaacaaaacaaccatccagaggcaggccaccttcaacaaacaaacaactcaccaaaatctgaaacactcagagcaggaatcccatccctcacacagaatgaaccaccttgtttctctccttagtcttgaaaggcttaccccctgagacattacaaattagatttcaatttaaatcaaaccacattcaaaacatacgtgttccatcacagcaaagccccatcaaatgagcttagtccacttaaacagaatgttgactccagctgggtgggtgtctgccagagttcattccccataggctaagtgttagtgaactgactcacaagttcatgtgtctcctagcaggggacttgtttgtctgtcacaagattggccaggctgtgatagtgcctacctgaaaaagagaagtgcctatgttgaaaacgagttgccaaacaagaccctgagttgagaaaccaccatcatcatatgctgatgatgacaagaaggtaccaacggactgtgcctaaaacgcagcctctggtcaatgtcaatgtcagctagcgaatagtactagatgttgggagagtagcatatttcttacagcttcatgctgcaatctctaaagcacctggactaccttaaaaatacctgtctacctcactgactgttgcttctctgcccaaacttgcctttagctagatctccctggctaataagattaagcagccagtgtccacatctgccagagagttggaccttttgttaccacagacctgttgtggcctgggtctgtccctggagtgtgcacaagtatgtgtttgtggtttgaaggatgttagggccactccagtctctgccagatacaaaggcaatttaaagctggtgctttgccaaagatgccctatagatcctccatcttgagccatccctttcccactgaaagactgtatttgctggtttggtttggcagtgccatgtaggctgtgctcatcatatgccacgttaaatggccagaataggtcagaagtgaattcagcctcaaccccgagagaaccaggggagcttctgaatgagttgctcccagaggaaaaagcaacagaaacaaaagaaacatcaatgtgagaactcagctattattgcggctgcctatcttctgaatttagaccaagttcttgcaagggagaagatctcagcgttgttattggttaagagaaagaaaagccattatctcaactaccatataacaagtttaggagagacgttttcaatttattttcaaattggttgcagtaaatatgaagcacatttcaatgtgcttcttccacggtttgggtcctattacatgggcataatgttctagcaacactgtaaactcatgtcacagaaagaagtgattatttttcaaagaaagtagggttagctgtgcctgggtcagtcccagagagcttatttcctagtttccctgtatcattaggaggatatggagaatgacttcttctcctacagaaaataggctgggtatcaggtgtgccttacagagggagcagcaccaccaatgagaaacttcaccagctgcttccctgcaggtagacactgcattgagcatcttactacttctcactcaaaccaaatccatccaccttgactcaagaccacaggaatgtcaccaggctgttctgagcttttcatcaaatgctttgcatttcacatctaaggggactacatttaaacttgctctgtgttctttgggaaactcagtgtggtaaaaacagcagtgcccccaatttggattttcttgaattttcatgtttgatccagtattccccatcttcctgctggtttttggccttttcctgcactgtccacggactgaattcctgcccattgttcttgctcagagccacttcctggtccccaagaacagacagggagccccaccatctcaggcatcagcctgttgttgaacttctgtgctttcctcagagccacctcccaggcctcctcttgggctttgagggcagtaatgttgtctttcccttttctggagtggctgctaaaccaataccacagggaccctgaggaggcaatgggccttctgtacctgagggaagctttactcaggctaaggatgcccaggctctaagagccactgttatgggttgaattgtggcctctcttcccccaacaaaaagatatggtgaagtcctaactcccagcatctcagaatgtgaccttatttgaaaatatggtctctacagaggtaatcaaattaaactgagggcattagggtgggccctaatccaatatgactggtgtccttatagaaagaggaaattcggacgcaggcaaacacagagggaagatgatatgaagacaaacatggagaagacggccatctaaaagccaaggagagaggcctggaacacatccttccttcatagccctcttaagaaactcaccctgctgacacctcaatctcagacttccagcttccagaactataaaagacaatacatgtctgttgcttaagccacccattttgtgatactttgctacagcagccctagcaaattaatgcaacctctttgttatgacagccatacggtgggtattaaacatcaaaaggaattttctggaataaatgtcaaagtgcctctcaaatttataataaagtgcaatccaattctccttttaccttctcttttaaaaggcatctgaaatcactcattggttttttttttttttgaaagaaataagaataaatgagaaatgtatagccatcgagtcatatgacaaactggacttcaggccaagccaggcaaggaatgggagcagggcccctttgtgggggctgggcctgagattagtgctccttatgggttcagaggggattagggacaactagcataggatcccatggaatataaaagctcatggcaaaggcttggctcttaggaacctgggccagcatagaactatgtggactggaaccagataggcacccatgaaagtgggactcagcttctcactgctccctgcaaaaacaatctcaaatttgggacatcaagagtgtttacctgagccaggtcagggtttctgagcagccacacaaatgagacaacagaccaggatgacttgcctccctaaccaaaaatgtaccctctctgcatgaggatagcagaaggctaatcttgatgggacccaaagggccagaccccaaacacagtcacttcacctcaagtaagcattattataagtgataatgacaacccaaaactgagtcgtgactgctgttttgcaacatgatttcatccaaattctgtggctcgatcctccaggagccttgaaggtgggtactgtccattcactggcttgcctgagatcatatggcacatggcagagtctgaattcagactcagtccttctcatgactcccaggccaccagtgacatctctcccaaagccccagaaaagttaagggtgttggatgttgccatgaagttgcaaaaaaaaaaaaaaaaagaaagaaagaaagaaagaaagaaaaagaaaaaaaaaagctagaacaaactacaaactaatcaaaacaaaacaaaacaaacaaacaaaaaaaccaaccctgtatgtgcttcacaaagacagcagtaggaaaaatgttttgcttggaaaccaaaatatttttccagactacaaaaaggaaaagaccaagagtcgggggctcaaatgggcatggtgactacatttgcaagaatgacacaatggcttaggaattgctgaactgtttctctttttggcttccttcagtaggcaggagtgagtgtaggagcagcctgccatttccagccaactgcctagggagcagtgccacccccgactcaggctcaaaggtggcaccaaatggtgaaacaacaaggccaggttactggtggggctatgagatgatatcagaccattcaggcagttccctgattctgcccagtggggctcagcttgatggcagaggtagaacaatatcaatgctcaaagaaagcagagataaatcacgcccaaggccagaccctttgggattgggcctgcaaagaggtagaagaaaccattagctcccgtagactggaggagctgggctggggtgctacggcaggggatgttcgattggaggataaggggagcagcagctgccagctcacaaaagcacagaaatgcaaagatgaggctggctgggggtgtgagcacatgtgcctgtgtacatatgtgtgtatgtgcatgtgtgcaagtgtaaaagtgaatgggcgtgagggtatgtgcacgtgtgggcatgtgtctgattgcatgcgtgtgtttgtgtgtatgagcatgtgtgtgcacctctgtgcatgtttttgcgtgtgtattattgcatacacatattccaccaatgcagtttcccctggagttccctggctccccatttccaatgctgtgtcccccaggaagccagcagtttccacccgagctggctcagcaccactggaccaagggaaataatacaaggcagcaggcaccccagaggagggcagagcaagcggcagggggaggaatgctctgtgggcagcagagaaggtaagattagagattggagagagtgatccaaatcccacagacccaacagcagtttaccttgagcctggctttggagggttataccaagaaggctgtgtctgtctcatgagctcagtccagtgtcttccaaatgagtctctctcaagggcaccagagggccaggaaggggaggggagcaagccttggtcacacatgtgcctgcactgtcctcagtcttagatgccccagccacatcccccaaggagcagaccaccatatacatcttgaagaaagggccttccatgggccttccagggccccagtagttgctgggttgtgggaaaaacccagttctcttgctaagggactgtagtgaaatgacaaagtatccagttcagcgtgtgatgaatcaaaaagatttgcagtgacacaagaagttctgactgcatgcacaggcagaagctgaattaacaaaaatgtagtataaagtaaatggaaaaaaaatccctgagccttagcaattatccaaccaaacagtccaggaagaggagagggcaacaacctctataagtaaacactattactgtattctgattccacagatgaggaaacagggacacagagaaaggaattaacttggctctgatcagaattgtaatgacaaatatagggacaattctgagctgacaaggacatccagctttgctcctggcctgttggaatcagattgagtcccctccctggagaacaagatggagaagggtcatggttcttgtgaccccttggggtgcatgtgacaggggtgctcagttggatgagccctgtaagtgactgtggccaagggcagtgcctgcagcagttagcatagaggaagtagggggtgtgtcctgactggtgggtgggtgggaactggatcagggaggttgggcctttatcccatcaacagtgggaagcaatggaagggttctaggcagggaaattacagtcagatgtgggctcaaggaaccttgctctcagagtgcctgtctggacagaaggaaaccagtgaggaggctggagcaggcggagagacaagagatcatgagggttctctgagatgatggtggtggggctggcagtaagggcgagtagggagaatccaggatccagcctgtgcaccctcaagaaacccaccacccacaaagccaaatgccacctagaagacagcactgatctattgcttaataactggtgtttccagctatttacacacaacagtcccctccctgtcacagaacaggtgtcaaaaatacagcaaactgcatagtgctgcgacagtcaatttgacagttctaatttactgaggctgagttatgtgagagtataagcaaatcttccttgtcaaagttgatattgaaaatggagaaaaatgattgtggagtcaaatattctaataatttgagaggtattcttatttcctctggaaaattctagcactactcacatacatatggcctctcatcccctaaacctgtcctcccaaaagaacatgccactgggacacccagaaatatgggtggctccagaggtggcatcactctgtctcccagccatgaaggtcccgtgcaaatcagttccacaatctccaccaatgtaatgtaacaaaccttggtggaccctggggatgaatacctaaaagagaacatacatttcttagacaaaataaagcacactagttcttgactatgtttgcctgtttttcacatttttataatctctttggcattttaagtagaagaaaaaagcaaaagaaaatctcagtgaccatgtctctgtttgccacatttaacacctaaatcagctggggcactctgtttatgtcaccttctcctccttccaattcccactggcactgaatgacactgagttgccctcttggttttcccctctgtgttaaaggcgcatatttggttctcctggttggccctggtgcccacgcatatgtggtgggcccctgcttcctgccccaggtggggctggttttggtttcaccctgattctctgcctctaccttcctgagaatcacacagcaaagagcacacctgagccttgttacctctcctggccactcatagacaacccaaggggagggttggggtccgacttggggttaaaagtcaggaaagttcataagccaccacctgaattcacttccccacccagcccagggcaagagagagctcctaagatgcctgaggccatttgtctaggtcaatgaaagatactaagttgttatgtgaagcgacatggggacaagagaggtaacagttacattttgggaaagtgatttcactgactctcaaaaagtgaaaaggatttggcatcatatcgggtttctggcccggccagctcagtgtccacacatcagaggtgatgtttgcaaaatcagagatgggcaagacacactttgagctatcaacaggtgccactgaagtgcaaaccaacccacgtgcagaacaaccccaagtcaggaagtgggagagtctgatctccaaaaccaataccacatccataaattgatatttgtcactttacaatagtttcctgtttccctttgattgattacagtcaaggatggcaaagaaatgctttgtcctgttgagagaaatccccatttgcccatgctacagaccttctgtgaggagacacgagacagtggaaatggcccacagcttgctgaattcctgtgcaaatagactccttgttccacagctggaaggggggaagcctcgtggaagtgcaatgtgtcaggcacttgtcaagaaatagccccttgttcagtggctttggactacacgtgagctagtctgacctctgcctcgcagcagctaggccaagacaccaagccagcagtccctggtagcctcaattagttatttttcaagtgtgtcctgctccctgcccttataaatcaaatgtcagcttacatccttatcaattccaacttcacatcaggtctcattaaaacaaacatttacagtacaaatcaaatgagtggctgaaaagccaggttgctccatcacttgataaaaagaagagaacttgatttcaattaaggtttgcactgaacagtgaggaagcacaaggaagctgggaccagagacagggagagagaggagcctcccatggaatctttgccctcaatccaaagccccaggtgcttctcgtgcatgccctgtgcactctcaggctttggggcctggctgtccctggagagggaaaagggttcatcacacaggaagttctgctctcccaggatatccttgcctgggagagggccctgtcctggacaaggcagtcactcaggacaccgcagctagatctgccccatcctcattcttcagctggagaagagagccataaagttatttagcctccatgtgacgaagcaactggaaggctaattctggtgaccagtgttgacctaagaagaaatggatgctaggtgctctcagacctttccacctagcttgctgcatcttccctcccttaggcatcaccaagatgtttgcctatttggttggcacttgctgggtcctcccaggggctttagctaccccggcaaattggaaggaagtggtcccatgggagtccatgactgaggcactattcaggactcagccaaacatgtgttcaaattccagtcctccaccaccactttctagccctgtgatctggagtgaggggcttagccttgcttaacctcagtttcctcatgtggaggtttaatatcctctgcctggcagaatggctatgagactgaaagaacacatatgaaaggatcataaagccctctggatctggcttattggtgtccagactgttatatgtgcccccacgcccacggctgggtatgtatgtcttgctcccagggggaagcccttcagctgaatgtggaagaagggcgtggtggaggcaacagctgccggaggcaatagctgccagaggcactgctcatggagtgggctgaagagcaggaggaggctgggaatggcctcctacaaccttgatcttgccagagccctgcttcttgatctttgaggtgcattcccacataggaacgaggttggacagccccagctcctgcctgcctttgccaagtgttgcactggggatccagcaggaagtgaaacaaacccagactctttcttctgaggcacttccaggttagggaatcctgggcagtggctgccacacaccatactgtgatgtggcgacctccctgctggtttgaaattccttcatgtcagcggctgtgccctcccttctgtgggagctccaaacctcacacccaataagtgcataacacaagtatgcataaaagataaagcacccagtcctcctttctaggaggcagatggctgaggaaagtttgtttttagcctctgaatgtctgctgttggcagtgtcagacctgggcaccaagatgtgggctggaagagggaaagcatgtgtgccttgtccatactctggtggcaggctagtggggagtgtgggggagcagatagagatttaagtacaacagaaggcccaccagctaacaacagaggccataagtaacagcatgggcttgggggaggggaagaggaataggcattgagtccctttggagtatccagccctacatttcatgcaccctggtatttagttctcacacttattttgcaaggcagttatcattaacccatttcccaaatgcaataactaaagttcacagaagttcagcaaccggcccaaagtcgtcacaatgctagcaagtggccagaggctggattctaacccagactctttaatttcaaaggctcacattctttcctctgctctacccaatattcctgggtgtataattcaaacactccccatcaaacttcctctggcagtctgcacctatttaacacattcaatttactaatagtttacccacacttactgagtctctatactgtacaggcaagggcctggggagcaatattagagtattttccatgagaacaagaatttttgccaattttgcccattctcacaacctattgtctaaaactgtgctgcccaacacagtggctactagtcacatgtgaccatttaagcttaaattaattaaaattaaataaagttaaacatttagttcctcagttgctctagccacatttcaagtgcccaagagctgtttgttgactaccatgttgaacagtgcagatataagtcatgtccatgatctcagaaaattccattgaacagttctgctctggaacaatgcctggcactaaaaagatctctctttaatatagaatgaataaaaagacttgaaaggatataactttgacaaatagtaaatgtaggaaacagcatttcaggttgaaggatgaataaaccaaaaactttattgatttctatttctgataatggtggactaggtaatttgggtcattcctctcaataaaaacaactagaaaagcaggataaaggtgtaaatttatgaacaaatgaatatgaacacagactataaaataataagaatgatatattgtggggggtcttaaagtatggataaaattaaaatacactagcacaaaagcatgtaagtgggaagaggggacgtagaattgaggcattttaggtcttctcattgcctgggaaagaaattaacattagaccttgagaaatcaaggatgactgtaatctctagggcagtagttctcaaatgctgtctaaggatccctgaggtccttcctcgagaactttcaatgggtctgaaagataaaaactattttcataattacactgagatgttagttgccttttgaactctcctctcacaagtataccgtggagctttctagaggctacatgacatgtaatatcacaatagattgaatgaaggagcagatacaaaaatccagctgttttctatgaagccaaacgttgaagaattttgcaaaaatgtaaaacaatgtgaatctcctcactacattttttgtttagaagaatataattatttttcataaaaaatgttacctatcttgacacataattgtgtattagccagggttctctagataaacaaaaccaataggatgtgtatgtgtgtatatatgtatatacattgcattccctctgggcctcacacacacacacacacacacacacacacacacacacacacagaaagagagagagagagagagatcgagatttttttttataaggaattggtttatgcaattatggaggctgacaagtcccaagatctgcagggtgagtcagcaagctggaaacccaagaaagccaatggtgcagttcaagccagagttcaaaggcctgaaaaccaggagaatcaatggtgtagttccagtttgaagtctggtaggctcaagatccaggaagaaccaatgcttcagtttcagtctaaaggcaggaaaaagctcatgtcctagttagaaggtttttgggcagcaggagttccctcttactgagcctttttgttctattcaggctttcatctgattagatgaggcccactaacattgggaaaggtaacctactttgctcagtctactgatttaaatgttaatctcatcgagaaacacccccacagaaacactcagaatgtttgaccaaatatctgggcaccttgtgccccagtcaagttgacacataaaagtaaccatcacaaacagatttattatttgtaaatgaattgataaatttttttgtttttctaaatatatatatatatttattataccttgagttctagggtacatgtgcacaacatgcaggtttgttacatatgtacacatgtgccatgttggtgtgctgcacccattaactcgtcatttacattaggtatatctcctaatgctatccctccccccttgccccaccccacaacaggcccggtgtgtgatgttccccttcctgggtccaactgttctcattgttcaattcccacctatgagtgagaacatgcggtgtttggttttttgtccttgcgatagtttgctgacaatgatggtttccggcttcatccatgtccctacaaaggacatgaactcatccctttttatggctgcatagtattccacggtgtatacgtgccacattttctttttctttttttttattattacactttaagttttagggtacatgtgcacattgtgcaggttagttacatatgtatacatgtgacatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcatttttcatggctgcatagtattccatggtgtataatatgtgccacattttcttaatccagtctatcgttgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttccagatccctgaggaatcgccacactgacttccacaatggttgaactagtttacagtcccaccaatagtgtaaaagtgtccctatttctccacatcctctccagcacctgttgtttcctgactttttaatgatcgccattctaactggtgtgagatggtatctcattgtggttttgatttgcatttctctgatggccagtgatgatcagcattttttcatgtgtcttttggctccataaatgtcttcttttgagaagtgtctgttcatatccttcccccactttttgatggggttgtttgtttttttcttgtaaatttgtttgagttatttgtagattctggatattaaccctttgtcagatgagtagattgcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatattttaaattgtttcagctttactcttggatatattaagtgtcaatagatataatgcccataaggatgtaaatggggtccagagatgaaaatatttgagaaacccttctctaagttaaccactagtgaaaatatatgcatataagtattaggttggtgcaaaagtaatcatgggttttgccattattttttatgataaaaaccatgattacttttgcaccaacgtactaccaactaaccagggtagcggagagaggaagaatggaataattcttaaaaatcaatctaaaagaagaaatgaaagatgagaaaagggacttgtaagagttctttttatattttaggttcaaatctctttttagagatatgatatgcaaatacattcttccagtttatggcttgtttttgcttctcctaacagtgtcttttgaagagtagaactttcaaatttgatgaagttcaatttatttacttttctttttaaagcttttatttttggtgttgcatgtaggaactctgcctaacccaaggtcatatagtttctctcctgttttcttttaaaagtttcacagttatagttatttaggtctatgatccacttgtagttaatctttgaaatcagataatgtaagcccttcaactttgctctttcttttcaaaattgttttgtctatcctgggtttttgtatttctgtatgaattgtatggtatgggtattctctcctattttcttattctaatttaagcttatctgctttgttgatctcttaaaagaatcaatttttgttttcatttatttttctctcttgtttttatttctccatttcattgatttctgttctaatcttcattatttccttttgtttgctttgaatttactcatagtttaccctctttccttgaaatggaagcttaggttgttaatttgggaaatttctgctttttttgatataggcatctatggtaataaatttccctctaagcactgcttttggagtattccattaattctaggttatattttcattttcatttaacacgattttttaaaagtttcccctgtgattaattctttgattcgtgagttatttaagagttttctgtttaatttcaaaatatttgtgggttttcccagggtgttgtatatctcaaagttgaattctgcagtggtcagaaaatatacattgtatgatttcaatatttcttttttattttattttatttcaatagtttttggggaacaggcagtttttggttacatggataggttctctagtggtgattcctgagattttggtgcacccatcacctgagcagtgaacactgtacccaatgtgtagtcttttatcctaatgtactgagttttcttttgtggcccaacatatggtatggagaattttcttgtgggcttgaaaagactatgtatcctgtagtccttaggtagagtgtttgtatatataaatacaaggtcaacttggttgataacgttctgcatatcttctatattcttgctgattttctgtctagttgttcatcaattattgagtttgtggtgttgaaaatctacagctgctattgtaaaattatctatttcttttctcgattctctcaaaatttatttcatgtaattttgagctttgttgttgggtgcatatttgcttataattgtcatatctttctgatgtattgacctttttatcattatgaaatgtttcactttgtctctggtaatattttctgtcttaaagtctattttgtttgttattaatgtaattatacatgtatatgcatgtatttcttttttaaacattttgttaagagcactttaacacaagacctacccccttaacaggtttttaaaagtacaatctaatatttttctctattgtcatagtgttgtacatacaacaaatatctagaacttcgtaatcttgcatgattgaaattttatacatgttgattagcaattacccatttccccctttctccagcccttgaaaaccaccattctattctttgcttctatgagtttgactattttagatacttcatataagtgaaatcatgcagtttgtccttgtttgcttattttactgagcataatgtcctcacggtttatccatgatgtcacatgttgcaggatttccttctttctgtaaagctgaataacattccatttttttttttttttttgtgtgtgtgtgtgtgtgtataacattttaacgccatttattcgttaatagacatttaagtggttttctcatcttggctattgtgaatagtgttgcaatgaacatgggattggtaatatgttttcaaggtcctgattttaattcccttgcataaatacacagaagtgggtttgctgcatcatatggtagttctagtttttgatgaacctccatacttttttccatagtggctgcaccattgtgcaagcctaacaacattctacaaaggttccaatttttctacatccttggcaacatttgctgtcttttttttaataataaccatcctaaacaggtgtgaagtaatgtctaacacattttgattttcatttccctgatgattagtaatgctgaacatctttttatatacctgttggccatttgtacattttatggtctatttaagtctttagcccatcttttaaccaggttgttagatttttttgctatagaattgtaggcattccatatatattttggaaatgtactccttatctgatatatggtttatgatatatgcaaatattttctcctgttagataggttgtcttttcattccgttgtttcctttgctgaccagaagcctttcagtttggtgtagttccatttttcttttttgcttttgttccctaggctttggtgtcatatccatgaagccattgccaagactgatgtcatgaagcttttcccctatatttcttccaggagttttacagttcaggtcttatgcttaagtatttaatccattttgagttgatttttgtatatagtgtaagatagggtccaattttcttcttatatatgtggatatccagttttcgcatcaccatttgttgaagagactatcctttccccattctgtattcttggcaaccttgtcaaaaattagtttaccatatacgtgtgtatttatttctaggctctcttttttgttccattggtcaatatgtctggctttccaatggcaccatactgttttaattacagtagctttgtagtatactttgaaatcaagaagtgtgatgcctttagctttgttcctttttttcaagatttttttggctatttggggcttttcatgcttccatatgaattttagaaatattttctctatctctgtaagaaatcctccagggattttgataaagcattgaacctgtagatcactttgcatagtatggacattttaacaatattaattattctaattcatgaacataggatgtctttttatttatttgtgtctgctttaatatctttcatctatattttgtggtttttagtctagaaatctctcatctccttgctgaagtttattcctaagtatttcattttttgatattaatttgtaaattggattgttttcttaatttcttttttggataatttgttattagagaatataattctacttagggtttattgagcttcttttgtgctcacattaatggttttcatcaaattttggaaatttttggtcattatttcttcaataatttttctgctcttttctctctcctctccttctggaactccaatatgacacagaaatctctgagactctatttttcttcaatcttttgtttttctgttcttaaaattggataatattgatctattttcaaattctttcttctgctgtctgaaatctgctattgagatcctctagtgaatttatttcagttattgtacttcaaagtaagaatttacatttagtttttcttgttaatttgtttgcccttactgagatccttaatttgtcaggtaattttcacactttcttttaacattttaaatatggcttcctttagttatttggacatatttctaatagctactttgaagattatgtctatgtctaacatctaagttcctttaaaaacaatttctactgcttgttttttcctgtttatgaatcacacttttctgtttctttaaagccatccctatattctgcaggcaattttttttactgaagcctgacttttccctggtactcagaatggtttatggccctatcttccaccagcagttacagaattaagacaatatatatgacattaagaaaaacctgaatgaagttaatggggttaaatacattctccctccctcatttatcaaccttcgttttagtccacatgtatgaccctcttgccatacccaaccccaaatgtacatacatagatatgccaagcctggaaatttctggagtttattttctatggtgcatttccctgactttatgggggcttctgcaaaccagctgtaatggaatctcattacagaaataagtgaatctcttatttgagtccataaaatatgcatacgttattatctcctgaaggaattggcagtgagatgactgcatgcagaccctgtggcagtatttggcagctctctatttaattggtgcatatatgccaacttaaatccaacttaaatcctgaatattagagattatactaccggaaatctgaagtatttgcctcacagacatactgtcaagaatcaggcatttcccaaagattggaatagggaagctcagaggtacagttttgagtcattcattcattcaataagtcactccttgggccacttctgggactactgagcttgaaaggattctgaggtcctggcaaagctcagggggagactgtgattgattagtgatatctgacataggtaggggatgggagaatggcagtacctgtgccttgtatttaccatccttgggccagggactggttgcaaagccctagggaacactctaggagagggagacagcagatatggagtgtatgcttgcagtcatggttatgtcaatgaagactcaattgtgggcaggaggtagattatgccagttggtttcttctccatctacagagtccctcaaaacttagccctcatggtagcataggacagggcctgtttcctgcaaattgggtcaaatgattcccatctcccagtggagaataaaggatatgaggagaataaaggataatggatgtcctaggaactgaataacagtgtgtgctcatggagacctatgatcatgctcatgctctcaaagaccttgtggtttcaatgtcacctaagtaggttcccaaatccaggcctgagaagctgttatgaagtgcccccatcccttcccagtactttatgtctgtatctacacttctcctccataacaccatgctcacaggagaggtctgagagcctcttacactatagtccatattttggttatcatcttggctcttctgagggagagatactttgtcagtggttctcatacattagaatctcttagaggcttgtgaaaaacagattgctgggacctgcccccagagtttctggttcattacgtcttgggtggggcctgagagtaggcattcctaacaagtctccagatgatgatgattctagccctgtgaccacactttgagaaatactattttaagacaatatatccccatggactgaaaatctttctatcgtttaaaagttctaggcatcaagaaattggtagggctattgtgcacatgtgatggtggggttgggggaaaaactgagggggtagacagagggcttttaccaagggagaccaatgggaactctctaggctgtctagctgcctgccttctgcctatcaggccatctcctgtattttcattcaccttagatcataaggttactttcaactcaagttgttgacctggggcatgaggagatcagctcttttggaaagatgggtctatttaaattttgacatgagtgttgtctaggccattcaccatatctcttctgttttcattctaaagctcccagggaaacttcccactgctcttgttactcaagccagttaagcttcttctgggcaattgatgaggtttaacctcacgaagcacacccttcgatatggttaggttttgtgtccccactcaaatctcatcttaaattgttgttcccataatccccacatgtcgtgggagggaccaggtgaagacgattgaatcatgggggcggtttctccaatcctgtccttgtgatagtgaataactctcatgagagctgatggttttataaaggggagttcccctgcacacactctcttgcctgccaccacgtaagacatgcctttgctccctcttcgccttctgccatgattgtgaggcctctccagccatgtggaattgtgaatccattaaacctctttttcttcataagttacccagtctcaggtaagtctttatccatagtgtgagaactgactaatacatcttaatggtctgactacactggtgcagtcccacagtttagcaccaatggctttcctggccattgtctgtttttgcctcctaactggattgccagcaacaggagaacaggctttgtctccttgtcccttttttccccaacagcatagcctagcagaggcctgggcacttgccaattgctcaatatttcaattcaaggcatttaagagctagaaccatccttagagaccagctagtccagctctcccatgttacaaatggacaaactgaaacccacagatgacaggcttgcccaggacctccttatagggataagctactgaccatggaaagtcaagccttccttctttttgtttaccctttggccttatcatcccttattattctctgcatttcattcctgtcttcttctgcttcaaggaacccgattaaggagaggaaagggctagggagcctcttcacccattgacctcaaccctgcagggctgtgatagtcctttacagttgatccctttctaagaatacatttctaaaaataagcctaatcctgtatataaatgtttacatccaactcatatatgctgactctgggggagaaagggtcccaggtggaacatatgccacagagatataaaggaaaagggccaatcagcctccctcctgcctgtctcccagtggctattggaaagggaagggtgtgggtgctactccctggaggaagggcagagaaaaggcagaatctgtgactgccagtttgggggtgggggaagatcactcccctaccctgacctttggctttttatccaccaatctcaccaccaggagcctagcctggttccctatgagcatgaggcttcatcctcaccacttctgatgccagtataggggatggatggaaggtgtggaagaaaagcgtggaaccctgaaagacactcccaaagtgcttcagcctaagagagctctacctgctgatggattatgattctttctaccagaacaactacctctaactctatctcttcctctcccgcctgtctgtgtgtgtaataaacacacacataaatacatgcatatacacacagagagaggcagaatcacatggagcatttcaatcagacataaacagtttgaagggtgataagatgttttcaaatagagatagcaatgtgatctttgcaatggtgcaggaaggccacgtgcttgttagcgatcttgtatataattgtgctaaattcagcataggcaataggataagcactcagaatggctgcctccctccagacttctgagcaatgtaaaggacctttttttttttttttttttttcctgagaccgagtttcactcttgttgcccaggctggagtgcaatggtgtgatcttggctcaccgcaacctccacctcccgggttcaagcgattctcctgcctcagcctcccgagtagctgggattacaggcatgcgccaccaggcccagctaattttgtatttttagtagagacggggtttctccatgttggtcaggctggtctcgaactcccgacctcaggtgatccacccacctgggcctcccaaagtgctggtattacaggcgtgagccaccgcacccaggtgggacttttaaattgtcattggaagaagggaaatactgctgaggttttaaaggactttgaaggcagaaattcaaaatggagccagcttgctttaggaggttccaggctacacagtaagtttgaggcaaatggtacctgaggattcatttacttggaagatataagatgcataaggggccacgctcctgggcacaggtgagccagggtgtagactgcaggtatagatgctaattgctactgttgtgaatatttgcttctttgggcttcatgcttatttttccaaaatctcaatttcctttaaaatcaataaaatgctcttgtatctgggcagagatcagcagttcccaaagcacttctccaggctgcattgcatctggccctcccaacagccaagggagctggacagcccagctcttacatccccatttatggggggaagacaggtgcagccaggtcccacaactagagagaggcccctggctgagaagggacttcaatccaagggtggtctctcagcccctgtagtatttatcacctaaccactaacatgtaagggacttttacctagaggcaaagcacatgatccaaatccaaaaaactcactaatgccaattcactttccttcttgccctctctccctgtgtatctgtctctgtctctttctgactctgtctgtctgcatccaggcctgggctgacaggcatgtgcccagatgttttcctctttactgagaaagcaagccccacactatcagagctgttcccaccattgctggcagtttctagccagcctagaccccaggcctcagttggtcccaggtaacctcagttaccaaatgagcatgtgctgtttagcagctagattgtttctggattatgagtgataaaacaaataacaagtaagcttctagcctgtgcctgactgaaatgtggcctgtgaaagcttagcaactgcacgtgcacaggcggtcaggggacccagcgggccccttgctagctgcaacagaaaagatgtgtctgtagaagatggggtgctgaggcctgggacaggtggagatggattatggtggctgaggggtgacacagtaggccacctaatacttttatgataggtttaaatcaagcttagctacagctcaggtagcagtttccctggcaaaccttgtttgaccacctgtgcctccctcccaccatgtgcacaggcacaagaaatccctgtaaacaatgatgcacacacagacaagtgcacccagaggcacacccgctcacacacgtgtacatgggcacacacagtcatgtacaagcatgcatgctcccacatgccatccgtgttgggctccactcctcagtttccgtaccacttgagcttccacccgttggatcccttagctcacagacctacaaatgcccatccctagcacaagtgccctacgtcccttctgaaaaaggcccagagagggagcgtcagataactgagattacctgggaccaggtacctggatccctgaaatagggatctctcaggcttcagagctgggaagtcagaaatacttctgcatgcctcactctcagtgctgctgctgccactgcttcaggccttgctcctgctgtgtcccccaccctggggcacagtgagcccctgctccccagcgcttgaccaaggctctctgtacactaattaggcactgcctgcacctcttcttgtccaggcagggtgactaacactaagtctttctgcctctgcacccttgggcagcctctgtgccccttccatactctcctggggcagctctctctccttatctgaggcctgcccttcactggtatcccaggtcttagaatgaatgtctgccccaggcagagtattgttctaggacctgggatcctgtcttgcccaggcccagcctgcactgagtagtttgctttccttccatagctgctgccctgacccaggaggggtcccgtgaactcctgctcatagttaagcctagatgaacattatgattggaattgtgttcccccaaaagatcttaaaattctaacccccagaacctgtgaatgtgacctcatttgaaaatagtctttgcagatgaacaagttaaaatgggccattagggtgggccctaatctaatatgactgatgtcttcataaaaaggggacatttagacagagagacaggcaaacatagagggaagatgatgtggagacacagggagaatgccatctccacgcaaagaaacacttgaagctgcgagagggtaggagagaggcctggaactgattctctcacagctctcagaaggaactccccccactgacattttggttttggacttctggcctccaggcagagtttgacagggacaacctcacctgtgcagtcctggtgaactgcctggaggtgctgggcaggggctaactctgcctgctctggtttgatagccacatgcctccctctacctggtgcaaattgttcctgagggtcctgttcacctttccagatcatccatctggcccctcccagtaacctgatactcataagcacaatacattttttttcctatgcttccagcctttcaatagcttcttatggcccccagataaagccctagttccctcctgtggcccatggagcctgcctggtctggtccctgtccatctctatagccctgccagtcccctaccccagaaatctggatgtcatgttttgcccctccttctctctccctcatgcccccatccaacctgtggccttagtcctggccagactctcagccagctcactgttggttgctccacctccctcccccacgctggcctaagccctctcttctcctccctggatagctgtgccactctcctccctggaccctctgcctccaaactgcatgtctcccaccattgtccacgtggcagccagaggaatcctttgcaaacacaaatctgaccatgtcgctccccttcttcaaacattttggtggccctgagcacaaaggcccggctccctagcaaggccaccaggccctgtatgactgcaaccccattgttctctcctgcattgccttctgatttacaatatttgctgcccttgatccaggaaaccttgcagggccccacaacagaggcatgggttctcctgcaggaggccgcactggtgcaggaggcagcactggtgcagcaggtaggctgtgtagctgagggagccactgacctcactgctttctcaagagagcaaggagagttccccaactggctggctgtgctggcagcaaggtttccagggttgaggtgggtggggagattcgtattatgctaattagatctggctccttaggactgtccctcaggcactgatttctggaaagggctcattgagcttgactttgacagatggcctctgggatgaatgagtgtgagtgtgtacatgtccatgagtgtacataggtgtccagtatgcatgtgcgtctgggtgtgtaggtgtgactatgtgtatataacattgggatatgtacacatacactcctacatgccatgtatttgtgtgtatgtatatgtgtatgttgcatgtacacatgtgtatgtatgtatatgtgtatctgtgagtgtatccacatgtacgtgtgcatatattatgtgtgcatgtatattcgtgtgggtgtgtatatttatgtgcatgttggtgtgtttatgtgtgtgttcatgtgtgaatatggatgtatgtgtatacatgggtatacgtgcctgggggtgtgtttgtgtgtataaaatatatgtgcatgttcatgtgtgtgtaggtacatacatagctctgtatatagatatatgtgtatttgtatgcagaaagtgtggacatcaacggatgtgtgaatttgtatctataactaggttcatctgcaaaggtgcatatatgtttaggtgtatgtatgtatatgtatatgagagtgtgtgtgtgtttgggggatgcaggtatacatggttgtgtggatttgtgtctgtgtctgggtgttgtctgcatagatgtgaatgtatgtgtatgtgtgtgtaggtatatgtatatgtgcatggatgtgcagatgtgtgtttacatctggatgtatctgcgtggatgtagatgtgcagatgagatacatctatgtgtctgtgtatgtatgatgtgatttggatgtgtatgggcatatggatgtgtgtctatatcaggtatatcttcatgggtgtacatctatgagtgtgtcagatgcagatatgtacatgtgtgtagatgtgtgttcatagctgagtgcatctgcacaggtgaggatgtttgtgtatgtaaatggggggtgtggatgtatatgggtatttgattgtatgtttgtgagtgggtgtaactgcacaagtgtggctgtagggagggcattgggggagtgtgtataggtatgggtctgtggatgtgtgcctgcatccgggtgtatctacatggctacaaatgtgtatgtacgtatatttgggtgtgtgaaggtgtagatatttcagagtgtgtgtgtgtatgtgcatgcacgtgtgtttggagtaaagtcgagtatgtggatgtgtgtgcatatctgctgtgtatgcataggaatacgtttgcatatgttattggtgcagatggatgtctctccgtgtgcctgtgtctgggtatatctgcacaggtgcagacatgatggaagtacatctatgtgtgtgtgggtggaggaggagtgatgcatgcatggtgtctgccaaggccctcacatcccacagccctctgggtaattcatttaacgccacattcttcttccttgctttccacatatgtaaaatggggacaacaacagtttctatctcacaagtcagctgtgggcactcaatgagatgaatggaagctattgttactgcttttttcaattacccagtaattcctgagcttctgctatgtgcccagtggtgctggtggtctcaccgggacttctctcccagccaggctaccccaacatcagatctcccctgacagacctgagtcagttggctcaaggagagccccaacttgaactcagaacagtgaggactccttatagtcagcctggtgatgctgcaggcaaaagcacagaagggctgcaggtctgggccccctttttgggtacgctggcccctatctcccttcaacctggtctgctcagggccccaaagctaggttcatccctttaggacagtgacagctcctcagccatcgacttctgtatataagcatgtcagatgaggccgagcaaagaaacactgaatttaataaagccaaggaaccaggagaactctccaacccaaatcaatcctcgatgtgtttttaattaagttatagcccttgtgattaaagagtgtgaatttcattactgtgaccatttatcaaggagcatacccgctgaacctttgtaacaggcagggaagaaggctttttattttcatcaacaccaagtgccctgtttgtatctcaactgactcatcaaggaaaactgtctcccctcccaagctgccacccactcagtaatgacaaagccatgcctgcccccacactgcccatcaataggccaaggcagatgagtatgaaacttctgattttgttcaagtgtcctccacaaccctcatccagccaggctactgcactgccaaagtgcaattcgggccccaggagtcaaggtgcatagagcaaggagcctaggcattctcagatgctggagttggcttgtcctgaaaaatgatacatttaaaactttggcctaaccacaactcaactagctacataaatgaatgagggctggaggagggaaggaaggagaagagacaccatattggatgttaacaattgaaaggcaacctcagggactctgactttgctagtttctagatgtgtgtgtgtgtgtgtgtgtgtgtgtgtacatgtgttctttgcaatttgggaaattgttttattgaagtgttatatgcaaggaagtgcccagatcatgcacatacaagttgatgaattccacaatgtgagcacactgtaaccagaacccagatcaccaaacagaaaactagcactctccagaaacccccagagtgctcctcatagtcactattgccccacgatagtaaccactatcctgatttctactggttttgtttatttttatattttacgtagatggaatcagaatcagacagaattcccccccccgctttgtttttttgagacggagtctcgctttgtggcccaggctggaatgcagtggagtgatctcggctcacttgcaagctctgcctctcgggttcacaccattctcctgcctcagcctcccgagtagctgggactacaggcgcccgccaccatacctggctaatttttttgtattttcagtagagacggggtttcactgtgttagccaggatggtgtcgatctcctgacctcgtgatccacccgcctcggcctcccaaagtgctgggattacaggcgtgagccaccgcacccagccagaacttccctttttatgtccagcttcttttactcaatattatgtttgtgagatttgtatgtgaatatgccacaatttatttatccattccacttttttttttttttttttagacagggtgttgctctgttacccaggttgcagtgcagtggtatgatcacggctcactgcagctgtgacttcccaggctcaagcaatcctcccatctcagcttcctgagtagctgggacatgtcaggcacatgccactatgcctggataatatttttattattatttgtagagacagggtctcgccatgttgcccagactggtctcaaactcccgggctcaagcaatcctcctgcctcggcctctcaagatgctgggattaaggtgtgaaccactgcacctggctgtgttcgaatcttgatgggcgtgtgagccactgtgcctggctccattcaaatcttgatgggcatttgagttgcttctagtttggacggcattgtatcgagcaatgctgttacaaacatttgtgtacatatctattggtgaatatatatgtctttctgtgtgttatagtgcttagtagtggaattgttcggtcatgtatgtatgttcagctatagtagatacagctatattgccacagtgatttccaaagccgttgtacaatttacccacagtacatgagcattctacttagtctacattcatatatgagcattctggttggtccacatcctcaccaacacatggtattgtctatcttttttcttttagtctttctggcggatatgtagtcaccctgggttgcgttcctaggaaagtggactataagataaatattagtgtgcagaaagtttactggggagtgctcttaggaacagtatctttgagcaagtggagaaagcaggattaggcaggcgtagaggttggaccatgatgcagtcataacaaagaccttggccagtgccatggagaactctgaagctgggatgacccttcagaattgcctcagatttgggcaggggactgagcctttatacctcatatcaaccagtcattggatgcagacctccccagcaggaggaggaactaggctgtgagctgtcagtaatcgacacttacaggagtcagcgagatgagtacttcagtcctgatttgtggaggaggaatttgggaagcacactacagaattcactacagtagtggtattgcattgtggttttaaagtgcatttctctgatgactcctgaggttaagcatcttttggccatttagataacttcttttgagaaatgttcatttgggccctttgccaagctttctattgggatgtcagtcttttttttatttgtaggaattctttacatgtttgaatagttctttaagatatatgtctctggaggcactgccagagacatacatctcaaataactatctggaatacataatatatattgtatataaagaatttttacaaatcaatgtgaaaaagacagaaatcccaatagaaaatttggcaaggaatctgaatatatactataaatgtcttcttccccttaaggatgaccttcttccactcaatgttttttgataaataaaagttgttgattttaatgtagtctaatgcatttttaaaaatattattaatgtgtttcgcatctcatttaaggtctttgcctacttcaaggtcatgaagatattctcctatgttttctataaaatatttactttttaccttttacacatcacctagaattggtttgggtgtatgatatgaactaggagtcacgatatatttttttctatgtgatattcaattgacccacaataatttatgaaaatgtaattttttttcataaagcaagtgaccatatatatgtgggtccatttctgaactctattctgttacattttcaaattgaatgtccttgcaccaatatcatactgtcttatttattacagcattcttaatatctgttagtattaaaagtttttttaagcctgcttgaatttttattgggattgtgtcaaatctatgtattaacttggagaaaattgagatctttacagtatttagtcttccaatacatgactaatagcacatccctccttttatttagattttctttaatttctttcagtgttttcttgttttcagtgtagagatcttgcacaccttagatttatttctaggtatttggtgttttctgatgttattataaatgaaatcttttataaatttattttgtctttttgttgctaatatataaaatgcaaatgatttttaaatatgtttactttgtatcccactgccttgctaaattcacttattaattctaatagtttgtctatggattttattggatttcttatggacccaatcatgtagtttgtgaataatagatttatgtattctattctgatccttatgcttttctcccatttccttagattattgaactacattggacctctgatataacatgaaacagaagtggtaatagtaggaaacgctttctcattctcaatctatgacgaaggattttaatacttcactgttaattacgatggctgctgtagggtttttttgtgtgtgacttctccttatcagatcagaaagttcccttcttagccaaagtaagcagtagccaacttgtcagggtgggagtcatattacaaaaccgagggcagtgaagaagctgaagaagaacaagaagagaaccttgaagcaagaggagactataaatattcagaaagagatagtttgatttttttggttgatgcctccaaggctatgtttgaatctcctagtgaagatgaattgacaccttttgacatgagcatccagtgtattcaaagtgtgtacatcagtaagatcataagcagtgatcgagatctcttggctgtggtgttctacggtaccgagaaagacaaaaattcagtgaattttaaaaatatttatgtcttataggagctggataatccaggtgcaaaatgaattctagagcttgaccagtttaaggggcagcagggacaaaaacgtttccaagacctgatgggccatggatctgactactcactcagtgaagtgctgtgggtccgtgccaacctctttagtgatgtccaattcaagatgagtcatacgaagatcacgctcttcaccaatgaagacaacccccatggcaatgagagtgccaaagccagccaggccaggaccaaagccggtgatctccgagatacaggcatcttccttgacttgatgcatctgaagaaacctggaggctttgacatatccttgttctacagagatatcatcagcatagcagaggatgaggacctcagggttcactttgaggaatccagcaagctagaagacctgttgcagaaggttcacgccaaagagaccaggaagcgagcactcagcaggttaaagctgaagctcaacaaagatatagtgatctctgtgggcatttataatctggtccagaaggctctcaagcctcctccaataaagctctatagggaaataaatgaaccagtgaaaaccaagacccggacctttaatacaagtacagacgatttgcttctgcctagcgataccaagtggtctcagatctatgggagtcgtcagattatactggagaaagaggaaacagaagagctaaaacggtttgatgatccaggtttgatgctcatgggtttcaagccattggtactgctgaagaaacgccattacctgaggccctccctgtctgtgtacccagaggagtcgctggtgattgggagctcaaccctgttcagtgctctgctcatcaagtgtctggagaaggaggttgcagcattgtgcagatacacaccccgcaggaacatccccccttattttgtggctttggtgacacaggaagaagtgttggatgaccagaaaattcaggtgactcctccgggcttccagctggtctttttaccctttgctgatgataaaaggaagatgccctttactgaaaaagtcacggcaactccagagcaggtggacaagatgaaggctatcattgagaagcttcgcttcacgtacagaagtgacagctttgagaaccccgtgctgcagcagcacttcaggaacctggaggccttggccttggatttgatggagccagaacaagcagtggacctgacattgcccaaggttgaagcaataaatagaagactgggctccctggtggatgagtttaaggagcttgttcacccaccagattacaatcctgaagggaaagttaccaagagaaaacatgataatgaaggttctggaagcaaaaggcccaaggtggagtattcagaagaggagctgaagacccacattagcaagggcacgctgggcaagttcactgtgcccatgttgaaagaggcctgccgggcttacgggctgaagagtgggctgaagaagcaggagctgctggaagccctcaccaagcacttccaggattgaccagaggccatgcgtccagctgcccttccacagtgaggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactacctgaataaagagccctaagtttgtactaaaaagaaagaaagaaagaaagaaagaaagaaagaaagttcccttcttagttttctaagagatttttgtttgttttttggtgttttattaaggatggctgttgaatgttctcaaatgcttttctgcaccaattcaaataattgtatgacttcctcctttttctttgttaataagattaatcccattggttgattttctaaatagttaaccaccctcacatctcacatgcctacaataaaccttaattagttgttgaattagattgtatttccccagaagctgatactaggtcaggaattggagtacaaataatttatttgggaggtgaaccctgaaaataccagaagaactatgaagatgaagtcctctctgtctgcacatacacacatgaatgggacaatgaacatatatgaatatatatgactggacatacatatatatatatatatgcacatacatattaatggaaagggaagggagatatgtatttatattcatgtatgtatgtgttatatgtatatatataaatgtaacaataaatattgtatgtgtatatgtattggatttggtttgctaatatcttaagagtttgtggaactatgttcatgagaggaattggtctataatgttcatttcttgcaatatccttgtcaggttttggaatcaaggtcatctgggactcataaaaaggttatgggacaccccagcagagaagatggctgtggaaggccctggggaatgatggtgtgctcagaagatcaggaatgagaagagcagcacctgtagtggaagctgccagcctggctgtcttgggaaataatggccaagttctccctgttccctgtagatcctgtctccacagtggcatgatgaggggtgggaacatcaggttcagaaaaggtctttctgctctcagcttctcacaagcttaactgaagccccccgcctggggtgatagaagatatgacttcccctgagtttggtagaggcaagcatttccctttgaaagcttgttggtcattggtcatctccgtggtctcttctaaaccccaagagtcatccagggccatgcacccaggggctttttccacctctccattcagagcctttgatgccccttacacacctcttatcagctgttgaacaaactgtgacctgtctccaagaatgctggccagctgaggctgacaatggggcttggccaaccaaagtgatatggatagcaactggcagagggccaggatggcataaatgtcaaaaggtgcttgcacttgctgctgtgactgctagctgtggtcttaaggtatcttgcagaggagggggtaaaggatggtcccagaggcaccaaaaggggcaacaagcacagacatttttaactgccactcagagaacaacaactctgtgccaagccctgtgctgagggctctacactcacaatcttcttcatatacacatgggtctcactgaaaccataacacagcagagtgggaagggatattttaaccaactaaggtgttcacttgccagtgcctgggatccaaagtcagcatagccactctatacgctcaatcattgggagagggtaggaggagccagttggcttagtgacacatttaacttggagtacattcatcaagacatgcctggaaaaggccacagaggaaaggctccagagaggaagatagcactgggtgactgaactgaggggaccacagcttcataagaagggcaacaagaaccaggctcagcacttattctggtgttcactcaacagcatacaatgtcatcacattcactctcttactggaacctcctagggcgcccaggaagtcagcagggcaggagtcttctcccctctgaacaaatgaggaaagtaaggttcagagaggtgaggtgactttacttgccaaagacctattactggtatggtaggctaaataatggcccacaaagatgtccacatcctaacccctggaacctgtgaatatgactttatatggcaaaagggactttgcgtatgtaattaagttaaggatcttgaagtgagaaggttgtcctagattatctgggaaggctgtgaatgcaatcacaagtgtccttataagaggaaggcagaaggagatttggcacagacagaagaaaaagggatgtgatgacaagagctccatgtgtatatcaaggattgtgagtgtaaagccttcagcacagggcttggcgcagagtcattctctgagtagcagttaaagcaatctgtgcttgtcacccctttggtgcctctgggacctcctccgcaagataccttaagaaagagattgaaacgatgtgctttgaagatggaggagggggtgatgagccaaggaatacaggtggccaacctgaaaaaggcaaagtaatggattctcccctcagagcctccaaaagcatccagccctgttgacaccttgattttaggccagtgaaactgatttgttttggacctctgacctccaaaagtataatagtaaatttgcattgttttaagccactatgttggtggtaatttgttataacagcaatgagaaactgatccatctggtgagtggcagaactgggacagaagccagtcatctcatcacccaggcaaaggcagacgccatcatctgcttcttggcaaagtttcccagggcctggatagatgtgggagtggaggatgggaggacttcaataggaggcaatgatggttcggaagcaggaagctagctgctggaagccaccagcttgaagtcccttgcttgaggctcgtcatgtgattatccgaccgcttcaaggaagggactaggagcatggaggcagaggcctgtctttggccccagaagctgggacgtttgatccattgctgactgggtgagggtcctgctgattgagatggagagtccttagaggcaagactggaccgatgacttcttgaggtgcttttcagctctcaggttctgtcagtccctcttcatggaatcctaggtgccaaaagcagacccaggaagcctgtggccctgataacccaaggcaacctctgtctctctaaatgttcctgtggaaccgagtaagcataatcccagagggcagtttgggacagctcacacccttccagtggcggtgaaaattggtcattccccttggagagaggaggcgctcttggcaattttccagagctctaccctccttcccttgtgcccaaacagctgtgggcagatcaggctgggggtagaaaggaatgaattctattttcttccctccctgaggtactccatgtggtcacagaaggctgcacaggaaatataacggttgacagacgtgcggtgttttgtgatgtgaaaattaaaatcaccaggaaatgttcacgttctctctctccttctctccccccctcccctatcttccttcctctgagcctttctctctctctgttctcactcttcctctgttgcctttttccccccagttcattttaagtccctcaaacttcctacctccaagaacaactctctagttgaggcttggactttacaactttcacaaatcactttgaatccttaaggtgcctacagacctctcagtttgagcaattatgggagggagaacaaagaatcagggtgggcgagcttccagccaccactgccataaagttaagtgacaactgttcactcccaagcctctgagtctggacaggtttgaaaaatttgttttaatctcaaaaatctattcccaatgagcaattagaagccatttccttgagctcttactatatcccaaacttcggtttagttaaattttgtgaggttcaaattttgcaccttgagactctacttttctctaaatttcacaatttagggataagggtctgtttgtattcagcactgattggaatgaaaacatcattgagcttgccaagctgagacctggaataccacagcatgaggttcatatgttctgaatgagcaggtttcagaaagctgagcacttagatggtgaggcgtgtgacttgtaagatgtgctttctgtagggacacaggccatccccaccgctgcaccttcagcatctgtaaatggtacaagggctaaagtacttgcacgcaggcatttggattttcccctgtgtattattattggcgttatctaaggcaatgtccctatcttacttcataggtcaagagtatccccagggccacccagcaatgcctaggaatgaactcctagaatgaaaaacactttgggagattcttctatcaaccttcccttgttctataaatgtggacactcaggcctgaaagaggggacaggccctgcaacttgagatggctcagcaggactgggactcaggtctagctcgtactctccaccccaggcctagatacttgtccactgtgactacctccgggagccaggtgccagcctgggaggagccatatctgttttggagcaattgccccgggcatagcaaagaagggggttgagtatgagatagtataaggatggcatgtatcctttggtaaacaacaaatcttggggctggaaggctggtcaaaagtcagtctggagactggttttccacaacagaacgtgctgcgaaagagttgtgggcaaaactcggttttgaaaattgaatctttaacccccctgggtgccatctattgcaatcttatgagaactacttttgtgaagcaaagggtcttcttgtaatgcaaatttccactccctaattggcccggtgtgtaacttctatgccttcaattgctgaagggggccaagcccctttgacaccggtttttgttttggtttagcacaaagcaggtaggaggtagggtcaactcgcacctccctaatgctgccgctgctgcctccgggcgggagaagacccacctgggctccagggcagagctgggccagcttatcacctccccttcatcgccctgtggaggtctgctgcagagtagttaatcgggaagctgggagtgcaggtggcactctgtgccacctggagccatctccgagagagtgcccgcatcctccaaggctggagaggaataccaattgcacggttactgggccccctcaggagcccacaagaggaaattaaaaggcatacacacgcctggaataaaggaccctcttcttgcagctaatcactgaaattggtcactgggttgtcccctcccccctttggtgaaagacatggtctttctcttgttctgttccatcactgcgttcttagaaaagtgtgaggaggggggctaagctttgcacgggcatcctcccatccccgccctcaaggtctgcctttctctcagagtcctggcttttcccagcatggggggcatttgtttgtcctgtctgatgcaggagaaaggtcaatcccagcccctaggctatgcaggtgggaagagtggcctggcatctcttaagactgtctcctgcatggccctttgcaggttgtaaaatgcttgcactcccctccctgtatgggcttcacaacctcatcagggctcacagctgctattttaccttgagggcatggtctaaggtgacagacatggtcctcaggatttgaatccaggactttagctccaaggctaggataagctcttcccaccctctgtgctttagggcccactgtggccccagtccactcggcaatgggagagcctgtttgcatgcccttagcaaagcctgtggagccctgagggcaggggcaggaagatggccttggggctgccagggagatgcctaggaggttttggttattaattaattaataacactgtgtcccagcagtcaggctgggctggacctatgggagatgccctctagatacctgctgaaagcaagcaggaaagagcatgagacttactgtctcctgcgtgggaacagggggcggtgcttagtttcccctgctaggccagtaaaaggcttgggtcacctgattgccaaggccctgtgccacaagttctggagacctgatacaagctgtggtcttgcttcccactgtggccataggcacgtagctccatgagtgttctgaagaggctcagctcagggaaaatgcaggtggctgggcctgagaatctggggttgacaagaaaacctaatattcatactgtagtatattgaatggtggccccacaaagatatgtctacctggcacctgtgaatatgaccttatttggcaaaaggtctttgcagatgtaattaaggatcttgagataccatcccagattatccaaataggcactaaatccaatgacgtgtcattataagagagtggcaggagattcaagatacacagggaagtaggtaagggtgaagatggagccagaggttggagtgatacggccacaagccaaaggaacacctggatccaccagaagctggaagaagcaaggaaggattatcccctagagccttcgcagggagcttggaactgctgacaccttgatttctgatttctggcctccagaactgttggagaataaatgaataaatacatttctgcatcagtgaataagttgtcactgttttaagccacgaagtttatggtaatttgttacagtaggcacagaaaccaatacaaaatagcaacaataccaaggagaggaggggaaacaggaaggaggaagaggaagatgaaggaagaaggataaagtcttattgaccatccaccaagtgccatgcaggcactgccctacctgcctttagagtgtgatcccatttgatggctatgacaaccttgtgaagcaggtacttccctcactcctgttgtacgatggagctggctcagacattcagcagtgaaagcctggttgctcagctaggagaggtggaaccaactgagagagaagccccagtggtgggactccaggcctgccttgctgagcgggctgctaagggggacccagctagagcctggacaaacaacaggatttagggagatgcacaaggagcactcagtctctggggctttaggagagagaggtcacatttctgacccagagctggcctttcaggaatgggacatggctagcctaacccagctcccctgagccctcataatagagctggccatggaaaacggagcttcaggcacacacaatgatccctgctcaaggcggatccagacctggagctcccctgccgactgttgtttctttcctgggtacaggtctccgtaacctgccagaagcctgggtatacctctgcctcccatgttccttctcttttctctccacagccaatctggtcaattcccttcctgagcatttctctcacgcggtgcactccatggatgtggtggtccctttcctttgtctcccatttgcacacacaagcatttctcctgccagaacagagaagcatcacattttgctcttggttataacatgatcagagttgggaactggggctatgggggcagggagggggcaggaggaagactgttgcctgtgactgacagacaaactggctgtgctagcagagtgactggcctcaccgcaggcctttgtgggtcgtgagctgggctgcaaggagagggttttcagagccgcatgctttcctcacctgttaatgctgtgatgcacgtcactgtcaacgggtaccttcaatgccatgttgctgattctctctttcttcctgaaaaactattaaattatgtgcagtttatcaatcacaccatattaaactcgagggcacacaaacttgactgtggctgtatttgctgttgaaggcaggtcctgtggtacttaaggctgttctatgcatttggagcagctgattatcttttgcaatggccaaatacacccatagctattattttttcccaaaaatctctcttattgaaatccttgcagggaaaatgactttttattgcaagtaagaattctctagtccctaacccttcactgtgctcttggaatataatgcttgacagtgggagttgttgaggagcccagtagtcacatcagagcacagggcatggcacaaccctgtaccctctgtcccattctagtctgcttattcacatggctagcacctcaccagaaggggagccccttgagggcagggattttgtcctttgcactgttacactgctgctgctgctgatgtctagcacaccgtaggtgtggtacctggtaggtgctccataaagatcttttttcttttcttttctcttttcttttcctttctttctttttctttttctttctttctttctttttctttttctttctttcttcctttttctttctttcttctttccttctctctctctttcttctttcccttctttctctctctctctctctctctctctctctcttccttccttccttctcctttttctgaataagtgaatgaatgtgtccatcgggaaatgaggctcaaagcaggtcacaagctagcaaaaagcagagggctgggatgtgaacccagggctgatgttacagttcatgctctgcccacccctccccccctccatagtggctgcaggatggagcccttgagctggtactccaatggaggcaggtgtgaagagcctaggaagtcaaaaagaaactgtggacaaagagagcaagtccctgagtgagcagagtgaatggctgcctgggggccatgcatcctggggtggtgggggcaagtcagggaggttctggggacagactccagaggtgttgcttagttggggttgggtgcggcctctagctgtgggcatgaggtccagacagaaaggaccagccttactttcccaacagccagaggagccaaaaggaagaggtctacccttggcaaaaagcaaggaagaagtgggaaggggacttcagggacatctgcaaaggctgtggcaatctgaacaagatctgcactcatgttacatgtcaacagtctgaaccccaagtgtctatgccaagggcaacttcaggccttcaaagtgctgcaggaggcaaaggggtgccctagggattctaaactgtagtagagggaagtgggagaggccagggcaggagtcaggatctctgaatgccatctgtcatactgggtgactctgaatcccttctctctcagctcgtttttgtaccttttctcccctcttggacatagttaattttcttctccactaagcaatgggggcaacaagagatgcacaaatcgcctccacttccattcaacaaaaatccattgtataccctatcgtgtacaaggtgtcagagatcccagggaaagtaaaaccccatcccctcaagggagaaaggaagtcctaattaggtgagtttgccgcagggttggccgtgatctggatatgaatcctctggaaagaaccatgcagagggagggagtcattctcagcacggccagactgggaaggcttctcagaggtagtagggtttgagctgagcctggaagagtgaaaaggaggctggtaggtgtggaagagtattctatgcgaggaagaaagaatagaggcataggggcaggagaagtcagggtatgctggaggagcaaagcggccaggttaggatagagatgtgtgtgaggaggatgcggtgcagagagaggagggctgcagaggagggctggggtctgactggggagtgttgagtgccagatggagcagctcaggcagcatctcagaggcagcagagagcctttaaaggcttatgagcaagggtgtgtgaacttatttgaaaaaagtgtctttacggatgcaattaaggtaagaatcttaagatgagatgatcccgaatgatctcagtgggccctaaatgcaatgacaagtgtccttagaagagaagacacagacagaagaggcacacaggggagagggtcatgtgaagatggaggcagagactggagcgaatgatgcagtgacaagccaagcagcacccagagccaccagaagctggagggagaaggaagttttctcccctgagctttaaggagcctggtcctgccgacaccatgagtttagcccagtgatggtgattttcttactgccaggagtgcctggatccgtgtgtataccaagcactgtctgtagatggatgtaactttcatagctctatgtctctgggagctagtatgatcaatgaaagttgcatcgaagaccgatgctaaactcaaatcagctgtttatccttgtgtgttcctcagtcaacagatgataaaaatattgctagctgctgttatgtggggtctgcacaatgtcttgatgttggaatggaggtgagaatggccaaaaaggaaatgaggcccagccttgtgagtcttcctttccatcacagcctgtttctaagccaaagtggagaagcaccaggacaaggtctttgagtccaatgcagcttctaattacttgggaccctgagcggcactacccctaaggcagctccctgggcaggtggtggtggtagtggtggccacagggagttgccagtagccctcctgcagacacatcagcagagtcctgggagggacccagcctgctgggaaacgtccaaggagtctcgtatcctcatctttagtctcctggtgacaaggcaagtttataatctgtctgcccagagtctagtcaaataaacctgttcctaggagctttcctcactccgccagtggtaatgttttgcaaattgctcatccattcttccttgcaggtactggttccaggagggaatctgaagacaggctttggagagtggctggtgccctttacaggccctcacccccatccccgcactccccgcccccagaagtaacgtgcttgctaaagagaaatggctttgacaacttgccttaaataatctggcaagtgaatctcctttctttattcattagggatatttgcacctgaatcgcctctttgtttcttgggatttcagttctgagcctaagcaggcaaggctggggaatgacagggataggggctctggaggcaggggagggcggccagggttgccaactgagatgtgtcggcaagctctagagatgctcctgagccaggagatggctgagctggtgtgcactggtgtgtcccagccttcctctgcctccgcagacctctcgacctcagaggtgactcaaggctgaggtcaggggaattttcctcagaccacagagggagaggccaaggatctgtagtcagacagctctaagatcacttcctggcttctgcatggactagctgagtggctgcagacaagcattgcccttgctcactcgctcgccagtctgccaagagggagatgctaagaggaaaggcaggctcacaacacggctggcaggaggtgatgggattaaggctgcagaaagctttgccaatgcacaagtgaggcttggagaaggcgggcgctatcagggcactgcctggccacggggcccgaaggggcccctctcaggcaagtactctgtgaaacggaggccaaaggaagaagagtgcccctcagcgctgtgctaactgaacttctttccaggaatctttgttaacatttgccaatgggtagtaaagctcctttaacatccccctgatcgttgggatttcattcgttttcttgcttcacaaccttcttgtcctgaacatatatttgctgatgtatctggcaagacaaaaaaacaaacaaaaaaaaaaaaaaaaaaaaaggaaaaaacctgctataccaattagctacatttgcatcattattttatatgagcatgaaaggtttaaacagaatgtatccagattacacggattaattagatattttaagttttaaaaactgaaaaacaaaaaaaagcaagaaaataagtttgtataatacaaaactcatcaggctttgattttctaccgcgaagctattaaaaaaacaattaagacgtgaacagcaaactgatcctatgaataaatcagagctatcaaaggcacatgtttgcttttggattatgatgaatgtaaatttagacatgagctatgggcttgagctgttaattgcactaaacctgagctccaatcaggtgccagggaaggctgggctggggctgtgcagagcaggccaggggtgcgttggccttcacgtctgccaggctggtgccctttcatttccctctcacctacactgaggattagacttagtagatggaggcttgatgccataaattcataggaaaggagaccactagagtcttcagaccccacaggaaaaccccatcaggaactgaaatgcacattgcttggtcccttttgcaaggttaagtgatctcatgggacaggagacagatttgggttgctttatttccagttaaattctgagatgcttgcacttcggttttgctccaggaagaactcagttatgtctacacatatgcttaaactgtctcccattaataagctgcaaagacaggagccagtgctcctaaaaccacagcaaattgtcaaaatgcttgttgataagtgttccaaaacatcaccattacagcagactaaatacaagggcatctgagatgcaaacagcttgtagtggaaacatattaatattaggaaatttctcagttcgctcccaaaaacacttgccaggttcatacacatgccaggccccaagtccctccctgagcatgggcaccacagcctgaccccttggtgacttcagtcacacctgccagccctctggggaggcagtggcaggatcagagtggatttgagctggagtggctctccctcaaagagaggctcatctgatcaccaccccccataactccacaggggcctctaaccaacccgaccttggcatgagcagctgcaaagaaaaagctgtgacagggtggtctgtacctgctcagaagtgggacaccaccctgagaagaggcagggtgcatcattccccatggatacttcctggtggtgggaaaacaggagagggagcttctgcacccctcccaccctccccccaccccctcctttcccttcaactttatcttctacataggggaaggaaccttggccctggttcttattgcagcttggccactccccgcatggctcccagcacttcccacagttgtggagggtcgggggaggagtctccattttcccaggtgtgaaaccctatcacgatttgccagccacagtttccatgagcattttctgcactttgcttatattgatcctcacataaacagcaccaatggccacgtgagtagctgagtgagaccatgtaagctgagggggtggtgtggcgtgagcatggtgatgcccaccattcctggcagccactcttgggcatctcagaccaacgggtgggggccacaccccagcaggctcccgcccttggcagtcctgaccagatctgtgactattgattatttctcactttccaggctggaaatcaaccaactctttttatccagagattcacgactgtctctgaagggttaaaatataaatagcagtttctaaccatgctaataaatagatgaagctaagcaaacattttatcagctgtcctcacagcccctcagtgtacccgtcttcctgcccgcctcactaatgtgcccaccactttctctgggcacgctcacattctgcaaaggctgggagacaggctggccaagtgggtctaaaaataaaatgaacaagaggcaaaaaacaagctaccatcacctaagcaaaggatgatgtctgcccagggacaaactctcaggagcccacagtgggttgtctgcaaggggctgtggtctcctgggctctctgaggtgtgcatagactgctgttgtcctggggaaggacaagctgggttagtaccctttatcgtcccccttgctggggagcactctgtcactggagctgggactggaggtggggaaacagggatgtcccaaaaggctgggcctgccccgtctcatcctctccacgagtgtggtctcccgtgtccacacagcagacattgaagacatcccttagaagacatggaaggcacccctctccgcctctcctcaccccacccccatgaacactcctccctatctccccagctcctctcccacccgacccaaactgccctatccctctgccataatttagtcaacaatgccaaggtttcacatgtggttcagtggggaccagtgttcctctggggaggaaacccagcccccaggtctactgtgtgtgggcaggagctgggagcccaaggtacctcttccctccctcacagagctggaggccaacacgtcagctttatttgccctgaaagaacagagaacactgagtctcaagtcagccactgctgcagagagcaacaggtttgagtgggagggtgtgcagggctggcaaaggacagcctctttgcagaaacaggcctccctcatacaggccccattcatcaggacagacctggacagggtgctgctccctctctagctgggtgggcagctccttcggctggaccaccctttaagagatgccaactgtttgtcacttttctgcctggcacagtgctgggcattggacaggatgggggtctagtgagggcctcccctttggggatcttagagcatagccgggaggcagcatgagccagtttgggggttatgaggtcagtcaagcctgaactggaatactggctcctggggccacccctgctgggcactgtgtggcgttgggccaccgtttcctcatctgtacaatggctagacagagagaacctgcctcctccacactcacagcttctgatcatcacccgcatcacaactctggttgtcctgtgaggacctccctggaccagcactgtctgcagtggggcaggctgctctgcagggctgggggaagcacccagtcactggagctgtggggacaggggtgtcccaaggctgggcctgccctgtctcatcccctccaccagtgtggtctcccgtgcccaggcagcaggcggcaagagctgatgcagggtgactccgggggccctggcacgcctcgagccttaagccggtcagtctctgggagcctgtgggaaagacaggcagggcctctcgggtcaggcaggcccccagcacaaagtgctgacaggtggggagatccaggcccacaggaggcagggctgtgcccgaggtcccttgcaagtcaaggccccggggcgggggcggtccctgagtcctcagctggggctctcagcagggcctccccaggtgccctgggctctggaggacccagcagccccgtccaagatcctcagaaggaaccagtataatgctggggtcagagtgggaaaatgtcccacctggtttgggtgactctgagtccttctgcaaattcacctggtgaaggtggcatctgccccatgggtgcacactgtccccgggagcacaagacacatctcagaaacagcggcctcggccccagtggtggctgatggggctttcccagtggatgctcaggggaaccatggacctccttccctccttccccctctctccccctccctccatcccccctccctctcttcccctttctttccatccctctctccctccttctctccctccctccttccctctgtttctccctccctccctccttcccaggctgtcagggagatgcagggatggggcctgggctctgagttcctttgggactcctgcctgaatgtctatctgtctcccatagcccttcgaaggagtggcctcctgcccacaagctggagggctctgccatttgcaggctggtgcctttctcagctgctcctcttgcggggccactctctaaagagaacaggtgagagatcagtcacagacccataggcacgtccctggcctggctaagacatacaagggactgatatgaccctgggctctgggggcagaaccctgccctgccacagcacagatgtgggtggttctgtgtccccagcacagtggggatgcactgcagagacacagcatgcagtccaggctgtcccctccccgccgccgagctcgccattgccgtcaggtgccatggagggccatcattgtcatcactgccatagagggccaagaggagcgggagccactggggaggcagaggtctgctggggctgagggtgggccttggagagtgacacctccacaagactagaatggagccagagaatgaggacacatcagcagagtctgacctgtcagggtccccccagtccccactaagggcaagtggctagaggtcctcagaaaagccccccagggaagcccagaagcccccagcatagagctccagggattgagaagagtttggtgaaaccagaaactaccatgtggccctggtgaccctggtgccagaggagggagtggggttgggggaggggactgccactccctggggctccaagcactgcctctccctcagctctagacttatataaacaactatatatatgtatataacatatatacaacttatatatacaacagcctgctggatatgtgcaccatattcaaaccaactgtggtcatacctggacttcagtctttgccctcctacctcccactgaggcccacctggagaccagtgaggagatgcctgaagggtgatccccaatatacatctggagcccagatctgtcttcccatctccttccctgaccctcttccaggacgacccatgggcttgtcaatcccataggctctccagctggatctttcaccttttaccccagacttcacctcggcttcccatctcagcaaaggcactgccagcatcaggtgccaaggctctacccttcctgggtcttggcctcctccctcccatcctcacatccctccactgatgggaagtgtttgacttcatcaatctcaaacacactgaatgactttgctgggcctccctgggattggcctcctgctctgggccctaatacactcacactttgcaaggaaacagtgggattcagtcaatccataaaagcaactgattactagcttgttagaggcatgtatttattttgtttttcatgagttgtcttggtgattttccggtaaccaattgtttgactgttcatagcccttttctctaagctggtttctttgtgtaggtatggcttgtgtgtcagaaatgacacccaacgccactggcctcccatgggccccacttggtcagacccaggacaggccaaccagctggggcctgttggaatgggggcttccctatcagctgcccgtttgactggcttccatgaaagctgagacttgtttatgagaagagtggtcctgtccatatgactacagctctacctttcctttgagcttttttggaaaggaagtctggaaggaatctggtctttgatttcctcttggcccacatgaccttccctcttcacaatgcaaaggaaaagatcaggaaccaaacctggacccttgcctgtgaaaaggctgctgttccgcattcctaaaagagctgctgacatctagaagcaaacagtcagctgagagacaatcgggctgaggcaggctctggatttccattccattccttttcaactgcctcagtgccagctgaactacaagccccaggaggtgaaattgaacccaaggatttccccagctatctggaatgaagctttgtcttctataattagagtcccagaatgtcagggctgcaggggcccttaagatcagctggcctgtctccatcatgggactgacagccaggctaggaggcccagcttggggcccaccccctgcctccatccctgccagagcccttcctgctacaccttctgctaatagttttatctgtggacatagtggatgctcaataagtacttggtaaatggaatcagagctcttctgccgtctcccagtatgtgaggctctgcatgcagtcagccttctcagtaagtggatgtcaaatttctttcgccagagcccaacacctgcaggaaaacacacagcactgccacctggctttgaaagctctcagtgatcttgtcctaactttatctgacaccactgtcaccttgtgtcctacattcctctatgctggacaactctgttccctgaacacaccatgcaatttcccctccccgggccatcacttcagctgttccctcagaccaaaacgccatttaactccagctgtccaccaagacccttctcttttggcaaggtccaactccaggattctttcctgtgtgaagcatttccaaagggagctctcctgcttcctcccctaattcacttatttattcaacagatcttttaatgagtacccgccatgtgccaagcactgtttttggcatagggaatatagcagcgaacaaggcagataaaaacccctgccttcaaggagctgacattctagatgggaagagaggtaaacaagagaagtgcattatgtagaattttagaggtggatttaaattctccttctgcttgccctgcattttcttaccccaaattatccttattttcctctgcctcgtggtatggctacttcatttgtattcgtgtctctcacaagggaataaactgcctgagagtatggagccaagggctggtcttttctacagcccccacagcatgaggcattcactcaaggaatgtttgtgaaatgagtgagtgagtgaatgagcgagtgagcatgtgtgtgaatggatgagtgaatgactgtgtgtatgagtcaagggatgaatgaatgtgtgagcgagtgaatggctgagggtgtgagtatgtttgtgtgagtgaatggagaatgaatgaatgaatgagtgagtgtgtgagtggagaatgaacgaatgagtgaatgtgtaggagtgtgtgtgtgagaatgaatgagcgaatgtatggatgagtaagtgtatgagcgagtgaatgaatgaatgagaggggtaagtatctaggttcagaacacttgtgagttctggtttttctacctgtgtaagttgaaccgcttgagcataggattgctgagacccagaagaaaagtcagcattggctctcacactacagaacaaatgagaggtggctccagaaacttcaagatgacaacttcctggaaatgctgcattttcgcctcctttgactgtggactctggcagtctttcaggggacatctccagggtctagattggcttactccacacctgccgcccaggatgcgctcacatgctctcatagcaccttagatttcttctgcaaacatcagtagtacttacaaagaatgacaggctttttttcttcctatgggaaaaaaacacaaacactaactcctcccataacccattctttattaaatgtgtgcttaaattagctagttattacgttaccaaatcccttttaattatttgccaatgctttccatatcatttttaaccaagtgaatcttatcttaaattttaatttgatttgttgtttaaaggattaagggaatgatttcatgacctaaaatgtgtatggtctctttttaaaaacccaattggtgatgtaattgagttgcaaacactatttttgtcttttcacaacataatctatgggactttattttctcaagggacttgcttcatctgctttttatacacattcagtatctggaaatatgcttttggcttttcagtaataatattagacctgaatgctttggtgtatatcagcaggggtaggagagtgcaaggaagaatgctacatgcatttaaatatattaggtcaacagaataaaacgagtgtttacatgtatttacgaatattcaaagtaccttttggatgtttaagttcatagagttccatgacttaacccagagctagctgttttttgtttttgtttttaagttttgttttttccattagttttggtggctatttttctggctgctgctgttttaatatgaatgaactttgccttgtaaacacagttgcttagtgattaaatcatatgcttcaggatgtccttatgatcaaattgtgttcagaatgcaaagcagatccaatcaacaatgcctaagggggcctgaatatggcccaaagtctcacttcaaatctcaaaagtccaagccatgggcggtgtatccctgctcaacagccttgtcaagatgatctttatacagtcaggacttctctgattgactcttgggaacacaaattgaacttttaggattgaatggtggaaaacatactccaccaactactttatgggtctctttcatcaaaccagaatcacccctcagtttccaggccattttgccctttctaatcccctccctcttacatggactcgtaacaaagtgccatcatttcagctttctcttctaaatgtctcttggatgcatcccttcctttttggttccactgccacctccttcatccacgctccctgtgatctcagccttggaccactacaatgacctctatattcttttcttagccccatactgagacttaccttgactcccaaatttatcttcctaaggtgctcattcataatctctcttctctgtaacatgctggcgcactcctttgctcctcaggtcaggtccaggcttttccaattgatttttaagatccttctaatctgactatagctaacttttatccttctaatccctaatgagcacagcctgggtcaatagctgttgagagacttctgcctgccatggtattggtataaggcaagacaaatagaatgatggagtagaagagtgagcccagagatacagccatgcatacgtaaagtttaatttataacagaggagacactgcacaggagtggagaagggatagtcttctcaatcaattgtgcagggatactgaggtatccacaggatagaaaatgaaataggactcttatttcgcatcaacacaaaaatcaagtccagatggattaaggacttatatgttaaaggtaaaactataaagctttcagaagatcatataggagaatatcttcatgacctaaaggtagggaaaaatttcttaaacatgacatgaaaaacactaagcataaggaaaagatgggcaagctgtactatataaaaatgaagaattcctagtttttgaaaggtagcatgaaaagagtgaaaaagcaagccacagactgagagaagttatctgcaacatgtaaaactgacaaagggcttatatctagaatatatttttaaaatgctacaaattattttgaaaaagagagagaactcaacagaaaaactgtcaaaaggcttaaccagtaattcacaagccaggaaatccaaatagctaataaccgtgaaatggtgctacatttcctagtaaccagggaactgcaaatgaaaaccacaatgagcttcactactcacccataagaatggctaaaattaacaagagtaatgacagtaagtgttcatgaggatatggagcccctggaactcacaggctgcctgctggtgggagtatataaggggatgggcatttaggaaacatttctattatctaacagagttgaagatagctgtccccaatgacccaacaattccacttttatatatctgtatatagatatagacagaagagaaatagatatcctcaggaaatgagtacttgtgcgtattaggagacatgggcaatgatgctcacagtatccaatctccctggagctacctaactgtctgttgtagtagaatggccacatgaactgtggtgcattcatatgaaaagtatactatttggcagtgaaaacaaatatggatgaatcttaaaagcaaaatattgagtgaaagaggactgaccaaatgaatgtgtatgtatcatgcacacacacatacacacacacaaatgagtggtgaaatctgagtaaggtcagtggacatctcaatgtcgattttctggttttaatgttatgttacagttgaacaaaatggtaccattggggaaaaccaggtaaatggtgcatgggaccttcttgtactatttttgcaacttcctgtgaatctataagtatttcaaaattaaaagactaaaatttgaatttaaaaggaacatgcattattccatttctataaacttgaaagcaagcaaaggtaatccatggtgatctgggatgcaccttgatatggtaaaatacaaaagattggaaggaagtgattctcatagaagtcagggatgaaggaggggctcgactgtgacttgtagggcatgtgggggcttctggggaagctgtcaatgctgcatttcttgagctgggtgatgcttacactagtgtttacaacaatttgtttagctgcatatatatgtcttaagcacttttctttgtgtgcaatattaatatttaacaataaaaaaggcttcattaaagacatttaatgtctttaaagatccctaagtcattaaagatccctaatgtcattaaagatccctaaagcaccttagggatcatttcggacagatacaagtatcctccatcagactgagtcccacaggcagtgaggccaagtggcactccagaccctaacacagggccgacccaaagcaggcacaatgaagcaggtctagttgataaaattagaaggactgtttcaagaagtgctgccttccatctgcttttgaggaggcatctggaaagaggggaaagcaggcaaggcacatggcctgctatacagactgccaacaaatgggacacaatattgaaaaccaggactgtggttccacagtcatggtgttgtccaaccccaagtgttgtgtttcaagggctgctatttgcagcttggggtagagtctgtggcccccaaaccttgaaaatacctctggggaccctgctgggaatctagcttggccctgattggccacagagcaacaattgcccaaaattatgcctagaagacaatgtggtgttgccttctagagttgtgaggtgcagtgcccctaggggagattacccatatgctggtggtgtcattccaccactgtgccttccaggaaagagtaagctatgacttcaggccatggccacagcctactctcactttatctgtggactacccacttgtgccctaggagtcttctccactaaacattaaagaaggcagaaaggactgccgtgttgagcagaagaacttgtccctctgggcaggccactatggaatcaagggctgaaagctgctgtgaaatacaaaatgtaagcattcatgtaagccacttgggctgctagtaaaaggaccacagttactaaccacttccagacattggcctgttgggtcagaggtgcctgagagagcatctgagaagaggcgggagccctgctgaaatttctgatggggacctgaaatgcaataaaaggcttaggggctagccatgggaagaggaaggccaagctcatggcttagtgggcattgccattgtgggcagaaagaacagctgagtgaaccaccagggtccccatatctctgtcctgaagtgggacccctacctctagtcctgaatctgtagcccccaaaccttggaaaatacctcttgcagaggaccttgcagaaatttcagcttagccctagctggccacagggcaattgctgcccagaactgtggccactcacctctttgggccccatgtgggagtgttgtcttctggtcattgtctttgttattggttctgtttgttttttgccagtcaatccattttcctttcaggatgttatcttctaacttattttacaatttaaaattatgtttatctaccttttgattttttacttgttttgacaagggagtgggggcaatgtcaacacgagggaaatagctctgaaatgaattcctggtctagacaagggaggcaggaaggaggcccttggtagaagctgcatttcaatctcagggaatgcccctgaccatcaagccattctgctgggcaatgctatgagctgctgtcctttgtcaattcacctttggaagtccaaggaaatttctagatgtttctgacagctaatgactagagctttagcaggggacaactgaccacagtaatgtggggaaggcaatgagtgagtccagctcctcatcctgagaaagcacccttctcactaccaccctgagaccccatggaaaggtgaccctgatttggttatacagatttgcataacagaaaccagatggcaggaactcccttagctgtgcagtcagaacccattcaggcattgattccctaaaatcccttacctcttctaagcacatgcaagatcctacctgaggttggtgttcttcaagaagaggggtcgctgggaagcccacagccctgagaggtaccccctgctactagcatatatccttcatagagcaagagccagctgaggaaggggcagcctccaaaggggacaggctccttgagtccctggaaggacttcattacaatcaagctctcagcagccaaatttctcacaccgtatatctgtccaattgcaacctggaaacctgacttacttgcacagcatcccccacgatcgcatatcaccgccaaaggcaaaaggtagggacttgaactcagatccctgtcttttgtgtacagtgagtgctgctagcctgcacaccacgagatgttctgttctggtacatctcttctcccacgtgaactgaggtcaagttgaattggaatgactatgacagccaatgtcaatgaagaatgggatgcagagggcacaagagatgagctgccttgattagtatttgtctcagtaacctgtgtttgttgtgaagagtaaggcatcatcatttcccaagctccaaggaaacgctgttccaaaaagagttgctattttttgaattgttctactcccgtgctgctgatctcttgtgagaccctggtagcaggaccccacactgagctgtaagacactcatcttgctatgacaacccctatcttctgtatcacaatctatggaatgctcaaatttggccaaattgtggacagtgctcaacatagttagcattattgtgaaagtttccagaaggttacaagaacagccagatccctgattggaacatgaagacctggctgagatttctatgttctctaatctggtgatggatgaagagggttgggagggggtgtccctcctgagagcgtgggctgagccttcatctcaactgagagaaggatgctggggcaggagcattgcaccttctgggggttgagataaggaaaagggctacgtgggtatgtatgttaactctcaacctccaagtcaagtgctgagggctcagcttggggatttgcagacagtcaaaagagttctcccacacttggacacaggaaggggaaaatcacacaccggggcctgtcgtggggtggggggaggggggagggatagcattaggagatatacctaatgtaaatgacgaattaatgggtgcagcacaccaacatggcgcatgtatacatatgtaacaaacctgcacattgtgcacatgtaccctagaacttacagtataatcattaaaaaaaaaaaaaaaagagttctcccagacatgcagggacagagcgtcaaggcattccccagcctgaggcctggtggggcccccaggtggcaggaagaagcatggaggaactgagtggctaggactgtgaatcccaggagcagccacttcacccaaagcagcttgagttacaactctgttgattgactgatgacctctaggcccagtacatattgcttcacagagcctagagaacaaaatgtacccaagaggtagggctggggctgctctctcttttcttgccagaactgaattctactgtgtcctgaggaggcctgggcagtttgtgtggtgtcagggccagacgcttggcacagcctttggcctgcccaccaggggcactctaagccacatggtgccatggtttctgtaaggggattcctgggcagcccatgttaacaaatgggaatggattctggagagaaagaatggggtagaccccagatggtgatgagatgacagaaacatttgtgaacacttatataagctcctttggggactccctgaaatattcagggggtggggagggagcctgaaatattcagggggtggggagggagcctgggtgaatagatagggcgagaagcaggcgactagcttgttaatgttctgggaccctatctctgcaggctggtgaggtcctgaacttatagattacagggtaatgggaaatctgtgaggaggaagtgctggagtgttgaggtgcaaagctgccgcacaccccacgagccctgtaaagcagaacccgtggccagtttcagggtgcgggggttttctagatttccagcccctgctgctcctccacttagacactacatttatttattcttatattgaaagaaacacaaagtaactcattttatttatattcttaataaggaaacaaagtttccaacatgtagcagcaaaataataacagcaacaataacaatgtgtgcattaccaaacacaccttttagttgaatggaaaaccttttactttttttaacttttattttaagttcagggaaatgtgaaggtttgttactagacactatatttattcagagtgctaaaaatggtggcggcagccttgttccatgccagttgagtgaagctgaagctttgatggctggaattcccttcccctaaacagttctcattcagcaggagccacatgaaattcaggtgttatttggaagatggaagtgaagccagtgtctctatcttttgtctcctcttgttgacatggggcagctgctctgtgacttccaggaaccctgaacatttttgccttcatggggcccttcttcaattaccaataaataatgataattatattttatgattgtgttggtataaagatgaatacattattatataagaaaatattgtctttaatctaaaagttcatttctttccttctgattttaaaataagtttaattatcttgtgtgtccttaaaagtctcatagcctactgtacctaatggagaggttgaccctgaaagggcctggagcttgcttgcccatgctggttctcagggatcagtgtttgggcttggaaggagcaaggtttgcccatggactagatgaggcagcacaaagaaatgggtggattggctgctttttgtctttgggattaaaaataagtctattgagtgttgtggaaaaatcacagtcttacaatttagatgatcaattatgtgggaaaaaacaatgtccatgagaaaaaatcagcactttttaaaattattttaaataattgtaattatagctaacctttgttaagcacttattacaagccacatactgggctaagcctcactcctttcaccttcacatgaaacccattttagagaccaaaatgttgaggctgcaggctgatgaggcagcggaaagtcagaaatgaagaccataaaagaatagagaccaattggtcagtaggaagaggaagtggggagaaaggattcaggaacagacactcagggattccccgtgttctcatatttgcccttctagaaccacattacatgatatactaataaataggcttaggacaacagcacagaaccagatgtaaaagttaacagtttcattaacacttttcaagaaaggaggctgtacttgcttctgattttcttctcagtgatttcccaggccaacaacagagggcattgtcatattgaatgaagaggacccatctggagacctctgggaagtcttaggcatcaggtccttcccaacttccccaagggaccgagccaaggcagagctttgtgctctgagagaaaactgtgcttcctggctccagggtagagaggcctcagtctggcacaatttcacaagagggactaaaaggaagacaggaatgtgaccggctgtattctacgtacaaggatgtggcaactctgagggaggaagtgatctactcatggccatatagctaagtagtgaccaaatcaggataagagccacgcagtgtgactctaaggaacaccacagcacgtcgcccctcacagggaacagagctggcattggctgctcatctattatgtgccagggcttccacgtattgtcttatgggagcccaacagtgagtaggggaggaaagtcatgctcaggcctgctgtacagataacgaagctggctagagtgctcagtgcgcaaaagggagagggaggcaccaaagtctcagaactggcaggaacctgcatgcccttctgttcagccttccgtccactgctttgaactctcaactggtcttcccatcggtcccctcactttttattgtggtatatgtgtgtgtctctgtgtgtgataaaatttgtcagttcatatttttagtgtacaattcagtatacttaggcattaattacattgacaacattatgcaacaatcaccatgtaattgcagaacacttttatcacccccaaaagaaagcctatacccattaagcagtcactctcccatttttccttctccaagctcctgacaaccattaatctgctttctgcctctgtggatttgcctattctggatatttcatataaatggagttatacaacatgtggtcttttgtgactggcttctttcacttagcatcatgtttctgaggttcatcagtgttgtagcatggatcagtactttattcttctttattgctgaattgatattccattatgtggacatagtgcattttgtttatccattcgtcatcaatggacattttaggttgtccctaccttttggctatcgtgaatctgtgatagacattcattgtggggaaaactgtttccaattctcttggctatgtatgtacccaggagtggaattcctgggtcatatagtcatcctatgtttttctgaggaactgccaaactgttttcccagtggctgtaccattttgcattcccactagcaatgtacaagcgttccaatttctgtacatccttgccaacacttgttattttctgtgcatgtgttgttcttttttttttttttttttttttttttaccctagtgggtgtgaggtggtatctcattgtggctatcatttgcatttacctaatgactagtgatgttgtgcatcttttcacatacctatcggccctttttccatgtttctgaaaaaaaaaacaaagcatccttactgggcctccaaggccctgccccactcccggccgcactgaatggtccctggccctccacttccactctggcaccagccacctgggcctccccttcctcatgtgcacacacagttccttctgcctgcgagtggcctccgtgctcccctccatcttttggctgagcccctactggcatgcccagagcatcatcttgcactgccccttggtgcgcctcatcccagtgatgggcttcttgcttcttgcagtttcctgagggcaggtgctgcatctggcccgttcactggagtgactccggttcctggctgagggctggaaaaacagtatgtttggatccacagcaccagatggaagactgaactgaagttgtgcaggtttccttctgaaagactgggctctcttgcccaagaggcactggcggttccatcttgggactcttcctgctccagggcaccgagcacccagtattaggacagcaggatagatgaggcatccccaccgtctcccattgacatctttggagctgcccatcctcagctgtggtctgctatgactcatgccctcaaggcaggatgagtgttgtcagcaagtgactcatggacatagctcctcagccttggcagccttgacagccagctaggtctgatgacataggagagagagccccacagtgggaggcagggaccacagttccggtcccagtctgtgatgactcaatgtgtgatctggggccttcacttccccagcctgtagagtctatctgaaccacctgtggatccctttcaaaaatgcagctggctacactcccacccctgctccgaccctgagattctgatttagtggctctggcatggagcccaggaaatctgcagtgtattcagcagccccagtgccgctgatgctcaccccgccttggagaatctgcacaagctgctctgagggccctgtccatctcccagactttggtactagaattctagaattcttcagaattctgaacagttttcactgggcaagttccaagaagttccttgaaggaggaataagctcactttctgttccctgaacacctatcctgggtacccacccagtgggagtagtgggacatactgtggggcagggtggcttagaagctcagccttcagcctgtcagccatggagaatggtggcaggcccaggggcagggtctactgggagtggagcgctgggcgcttgtggctgcagcactgtagagggcctgaggatagggccacctgtgctactgagctcagagtttcttctactggagttgccacacattctgcaatatgcacccaaagacatcacctccccatttagggtggtcctaatggactgaggcctaagctgaggcttccagcaaacctgctccaccatctgctgggtttttgtttagagcagggaggaggcccactctttgttgagggctgtgttcccagaggggagctaagcagcaccttgatgtggttgggagtttgaaggctctgggttccccatccatttctacctccgcaccatcttgggcagtccagccaccctctctcaggcgtggtctgctcctccatgaaatgagaatcccattagtatctgacttaggatttcaatgatgcttaagtgagaggctgtacagaaagggatctttgcaacagtcttcctgttctttatggcagaggagaaactccactagacctgctggcttcaagccatggctgctctgccaagctccaaccatgcccccgggaaggcaactccacaaagatgagccagtcttagggcaaaaaactgtgagaaaaagctggagagaacacaaattcccagggtcagggggaggctggcagaggcagctacaggagagaagctgctttgtagagagccattctgatctagtgccgagcaggcacacagaagaccagaaacatccaaagagagctttgtagcttgagggacccccagagggagtgacaaggctgacaacaggtagggtgggggcattttcacaaacctgggttccccaggcccagcaacctgaggcctcctagccttggcctgcccttgggagctttgcagctgctagacactgctccctcctcttgatggaaggttgaattgtgggctagaatccaaatatgtggccactgtggactcaggggagagggggctgcaagaatgggtatctccagggaagaaggcagagttgggccaaaccttgggcccccaggcccagactccaacagagacgctgtcctcacatagctctcctcacagggggctagtctctgggcagagaacaggatattaggccaacggcagctttgggagatggggaggtgggggagcagctgcaagaaggcctcaggctgtccagactctggccaaggccaccttccctcccctcacaggcaggccaccacccagaagcacaatctgctcatctctgtattggatttgtaaaccacaccacgcccagggtctccagcggctccaggcccttgcctgcaggccgcctgaatggctcccagtaaatccctccaaactaagtgtggaccaagtcacctcctgtcagaacccttcatggccccttctgccatctctacctctataggagcctctgaatgcttaggagtaaagagccattgaggagctgtgaataatataatcagaattttaaaagcatatgagaagtggtgctaagaggtcactctgaagctccagggcaacttctgtggttttgactgcttttactgcccggagtacaccaccaactgccagttgtttttgaatcatagtcactggagtgactagaccaagagggttcagggctattgttttcagaactgagcctgtatgaagacagcccaggggctactggctctttggcagctctgacttactaccttttgctggtggcttgcccctccaccccagattttcttctcccatcgaaggggacatctaagtcatcagtggcctatggaggatatcatggccatgagtgtggctctcatggtcagggtctggtcccacttgctgcatacttcctgctacacaggaggcacctgatctcaggcaaagaggacaccagtggggctaggcaagggtccctggagagcatgcgtctgctactactatgcattgggcagggactatggcccagcacagcagaattcaagaagcataggcacagggcaagagatatgagcatgagctgctgtcagccatcatcaatgagctggtgcggcacctgagatatcccttgtcttgctgggaccagccattgccattagtggctttctgggaggttgtctgggatcaggggctctgcagccaaatgaaacctccctggactgctggaatgtcctctctcaggacagagtcaccttgctcctagaaaaagacccaggaaggcacctacctttcttctgcctcctcctcctcagcactccttcctccaggcggaaagcactatcctgtccaaactgtcctggcttacagaatgcttacccagtgtgcatgatggaacactgatccccacaactgctctggagaaggataatcttcccatctaaagaagaggaagctaaggcctagagaggagaagggacatttcaagaacccaaggtcagaaggaaccataggcaatagcctcatcaactacccctaccccaccagcccagacctggcagaggatttcaggttaagcatccccagcagaagctagtttcaggccaggttgctttctgcttctggggaccctggatgtctacacaatgactgcaattcttccttttctgattcgattggccatcttccggaaaccactgggccaggcagagtggaggtgaagggaaattactactcataaccctgatgtatttccttttcttaaatacaaattaccgcagcccccagccctagtcaaacataaagggaaggagcagctcaggcaggtgtatcctagtgctgcacacttgatgtccatattgctgtctgctctgactctgggcaggtttgttttaattaatcaaattgctatcaattcataggcttcacttgacagcctcaccttctaatgcggttaagtccaaagcctgaagctcatgggccctgagcaggtctgacaaggaatggagccaatcatgccgccttgaccttgagtgagtcactagaagttccctgggtgccacctggcagggtttaggcccttggatggctcacagggtcagggtcttgggagcagtgtggtccactgtatgtttcctgaggctgctgtaacaagttaccacaaactaaatgacttaaaacaacagaaatgtattgtctcacagttgtggaagccagaagactgagatccaggtgttggcagggccgtactctcttagaaggctctaggggagactgtttccttgcctcttccagcttctggatgttgccagcatccttggctatggctgcatcactccagtctctgcctttgtcttcacatggcattctctgtttttgttttgttttgttttgtttttgtttttgtttttgttttttgagacggagtttcgctcttgttgtccaggctggagtgcaatagcgtgatctcggctcactgcaacctctgactcccgggttcaagcgattctcctgcctcaggctcccgagtagctgggattacaggcacccaccagcacgcctggctaattttgtatttttagtagagacgaggtttctccatgttggtcaggttggtctcgaactcccaacctcaggtgatctgcccgccttggcctcccaaagtgctgggattacaggtatgagccactgtgcccagctttgttctgcatctttctcctttcttctaaggacaattgccattggatttagggcctacctgaataatccaggcttatcacatctcaatgtccttacctttatcacatctgtaaagaccccccaccctcttttttttccaaataaggtcacgttcagaggttctgagggttaaagcttggacatatctttttggggtccacccttcaccccagtacatacactcccactgatggatcactgacttccaagaagtctggctatcagggcagtgtggcctttggcaggatcgactgacactttctcctttcagagctaaagtggctgagagcctgaggggaggaggctgcctggcctcaagttcccctggcaagtgaggcacgtaatggaggagggcagggacttgtctctcagcccctaggctcctattgtctggataagcctgctgagctctgagccaggcctaacacatttacatgacacaggcatttgtcaagggaatgagcccttggggtccctggacacaaggcagggctgagcattggatggggtgtgactctactcccagatggcactgggaggccttgtcccgctacaggcctcaggcccctcagctggaaaaggagaagatcttaggggtttttaggctcagtgaggatcttaggaggttctcccagtttggatacccatggctgcctgagaggccactgcagctccctgctcttagagtgaacacactggcaatatcccttctgcaatttcaacaggggcaccttgggtggcctgggactcatgggtccccaggaatggcccataacccttacaggaatccaagccagagcagaaagactttatagtttattgtctgggttaggcgcagaacaaagttgcactctagacaccccagaggcttgggtctggacgtggttgccacttgaagtttcctgctcctgtgacattcctgctctgtggccatccagtctctcctggtatgccaccatctaaaggaacctcagtctccatctcccttcttcctgaagcaacagatagtagcatgtttctgacttcttgagaagtcttctttcctcttgtgcactggcgcctgcacctcagtcacttctgccaccccacccccatcctaactgagccccacattgaggaacctggccacccacatcaggaggtgccctctcttctaccaggcaaatagaaattcttttgctcctccacccccagccttcccttcttcagatatgtttcagtttatcagggcctttcaacatgtgaggcccagagctgaccagagcagaacagagcagagaataggggagctgtgcccactagacactgtgccaaacctttgacacctagtatctcattgactgttcctaacagcactttgaaatagtttctactactgtactctgaaaatatgacaaagacaatctgagtctcagaggggtccaaagtcgtacaggtaataagtggtagcgtcaaaagtctaactcacaattggctccacagccacaccttacacgttgaactgcagaagaaagcagcacactcacccccttgttctgaatacttggcccctgtagatacagcctaaggccctgattgtttatctggccacccatcccggcaccaactcacacagagaggttgactattctcacccatctctgtgtcttgtcctatatgttctctgggccctggttcacggtcccttggtctccatggtctgggtcctctcctccaactaaaccatgctcaagcctgtgtaggttccttggagaagcacccttccctcctttttcctgctccacacccctgccagccaatgtgatcactgaggagagagaagttggagcacagcaggtgggcaaagggctggcacacaatgctgtgagctggcaactctaaattgagagcaattcctggaaatcaggatacaactgttgaggccaaaggcatcctaattaaattggccttcaaaataaacaagtgcgtctcttcaggcatcagctgtgattctgcagagttccaagatgagccctaaatgagataaagcctccagtccaggttgggctgggcatgtagggacagaatgtggggcgatctatgggagccattagcatgatcatgtttgaattgcaagtcatatgacagaaactgggagggaaggatctgggcctcaggtccaacctgtggcaccacttcctggctgtgggctctcaggtactgcacccatccttcctgcagggctatgaaccatgtcatccgcaaaatgggaggcaggggagtggcaagagacattgtactttcaataaagcttggtggcagggggcttctccctctcaagggttcttctagacctgggagctgaggttcctggggttggagtaattcagatgtgtaacactcttcccctacacctgaaataagaccatttttaagaagcatgcacaaatattagtaccaatggttccaatggtgacattccttggggactcaaaaaagtcagaatatgctccatgggctttgagcattaccagccacagccacatagcatttttaagttttacattctgggcaattcagtgcaattagacaaatatgttccccaatgtaatgatgaacaagggtgccctgtggggaaatggagaggataggcttggtgcctgttcttgatgatctcacagatgaggaaatacttccatctaatgacacccagcctgataagtgctagagaagatgctccaagagtgggctcaggaagctcagagtaaagcatgaccattttccacttaaaaacctgagaaagcaggccgggcgcagtggctcacgcctgtaatcccagcactttgggaggccgaggcgggcggatcacgaggtcaggagatcgagaccacagtgaaaccccgtctctactaaaaatacaaaaaattagctgggtgcggtggcgggcacctggagtcccagctacttgggaggctgaggcagtagaatggcgtgaacccagaaggcagagcttgcagtgagccgagatcgtgccactgcactccagcctgggcgacagagcgagactccatctcaaaaaaaaaccaaaaaacaaaaaaaccctgagaaagctttctggaaaaggcagtggttgacctgggccttggaggatatgtaatatttcaatggccagagttggtgatgaaggcattcctggtagaggggagagcagtgacaagggcatgagaggacacatttggaaaatggcaaggagcccatttggctgggtccctgtgtcctgggctgacatcatgggtgagggcaggtccgattctgcagatgatagtaagccatcaaagctcttaagtaagggaggtggcaccatgcatagccatgtgcaatggttctcagagtaggatctgtggacccgtggaggtctccaagacccttttagaggatcctcaaggtgaaaactattttcccaataatactgaaatgttctttgatattccactgtcatgctttccatttgcactgctggtgcaaaagcagaggtaggtgaaaagagcaggttcctgagcatgaattgggaccatggcaccaactgtactagttgtcaattggattcttcaccaccacacacctgcagtttaaaaaatgccagcttcacttacgaatgttcttagcgaagcagtgaaaattaactttattaaatactagcccttgagtccccttatttttaaaatttggtgagacacaatgagaactatgctcaaagcagttctgctggaatcaaagtgtagtcgttgactcaaggcaaagcactactgcgtgttttgagttgtgagctaaactggccgatttttcatagaacatcatatttacttgaaagaatgactaactaatgttactcagacttgggtatttggcagacattttcttgtagatgaacgaagtgagcctgtcacttcaaggaaaacaactgactatagtttttgccaatgataaaatttgagccttcaggcaaaaatttgaattttgaaaagcttgtatccaccactgtaagcttgacagcttctcaacagttaaaggctttttccaacgagatgggtcataatattaacaaatgtgatcttgtgatgttgtggaatgaaatatgtcaacatatggaggctctccataagtcagggcaccaccattttttaaagcgaccaatacacaatgttaccaaacaataaataggtaaaaaatccattcaaaagacaagagagtccaacggaaccaagtagagaaggctcactgataaagttttgcatcccacattacacttaacctgtaaaaaacaaccattggtggagtttttgtgtcctatcaaagacaaatgtccacaatgatctgaaaagtctattaaaatattcctccctttctcaacttcatattagtgtgaggccagattttcttcatgtacttcaaccaaacaacatctcacaactgaataaagaagtagatgtgagaatccagctgtcttctagcgagccagacataaaagaaatttgcaaaaatgtaacataatgccactcttttcaatacaagtttttgtttagaaaaatatagctattttcataaaaatactatttatatttacatgtaattagttcattattttaatttcaaaataaataaatattttaatattttttctaatatggtaacataaatagatatgacccacataaacaaaaggtctttggaggcctcaataagtttttgtcattgttgttgatttacctcattatatcatttttttttctgaagtaaaattcacatgacataaaattaactactttaaagtgtataatcagtggcagtaagtatattctcaatattgtgcaaccatcgcctctgtagttccacatttccttcaccccaaaaggaagccccgtaccattaaggagtcactcccctttctgctctttccccagtccctggaaaccactaatctcatttctgtttctgtagatttactctcaataagtttcaagagtataaaggatctgaggaaaaaagtttgagagccactggcttagtggttcaaatcccagctctgtttttattagctgtgattccttgctcaagttgcttaacttctaggagtctcattttcctccctaaaatgaagataataataatagcatattcagagggctattgtgaggattaaatggaataatcatgtaaagctcctggcagatagtagataataaatgggagttcttatcaccaagactgaatccagtccccacaaagaaacactgattccatttccatacactctgtagacatgactggcaacaccttaagaacaagaggcagcttcttcacctcattgtcacatgcttaccagccataaggctttggtgagtaactttacctctctgagttttgttttctttatctataaaatgggcctaattataatactaatcccacagggtatttgtgagaatcaacacaggagtgaatgcttacaatattcttggcatgcaggaggcactcaatgtcaggtagttgtctgggaggggttgcaacaatgataacgacatagatgaaaatgctgacactgtgtctcttggcaccctgtgggcagctcaggggctaccaccacaggttggcccttcctttgggctgtttcttgtgatgggcccacaaccccctctttccaggagatggcaagatcatcacatcacagtcagttcagtggcctaagaggcttcatctttacttagctgctctctgtgcagaggctgcttgggctttagaagagtgagtaagtttacaccaggctttttgctagagccccatctcagctgtagcccaagacaacactctagttccctagttatgcactcagctggattaaagggcactttgactactggctggtggaagttcccaagataccctagagagtccttaggggctcaaacttaatcttttggcatatcaaaggaaagaaacaaggtctgccgctggcatccattctgatggtgcagggctccctgtggtaaatctgtctccactgccattggcatgtggatccaggacctgtcaggcctgcagctattgaccttgagcctctcagttgtaggctgaccaccatgaagctagagatgtcaccatttagccacgcttcactgcaacatttaacatcctgctgatacggctgtgaaatctgaattcttgtcaaagtgatattgagagtggtaagctgaggaaggctggccctcgcagccatgtgtccaagggcaggtcaggtggtagggtggagaaaagacaagactgggaatcaagagacttacattcaaccctggggagagctggagacatgagctgcctgggcctcaatttccccacttgaagaatggaaggttgtactagctcagggctaactttagttagcattagtcagggagcaactgccactgaatattcactttcctgggcccttgaggagattctttgtgatttattttgccctggagaagcttgttctggtcctgaggacctggatgaacaggaacttctatcctgggtgggtgatataactcatcacatatcacaaagaaagctggctggctcaaagcttcatcccaatgggaaaggatctgtcttaagcttcttctcccatccaaacacccccacttaccaaaactcatcttggcaacactggcttaaaagccttcttgcctctgcccttttacaaactcatacagctggacttgagtcctcctagtgtcccactagcagccgtttggaggaggggatccagctcatctaaaggactttggtggcccaagggtgccacttccctgtcaggaggttagcagcagtggggagaaatagagcaagcatgaagggaatccatgatgtgcacagagggggcacttatggagacagtggccaaaaaaaagattggcatatctgttgatgggggatggcagtaggtgagcacagggtgggcaaataggaatacacctcagtcagggctggggaagtttattgggtgggtttaggaatctctggatttctgtgttccagacttcgcctggggataatatagactgggtccctgacataccatgtgctccaagtggaatgggttctgaatgactgaaatgtttacccccctggcactctatctgacgatctgcactgatgtactctgaggatgctgagtccatgtgctatcaaaggcatggaagtggctgggagggacgaaggatgaaaacaggagccagtgtaaagtgggagaggttagggctgctgggcttgggctggagaagcagcccctttatatagtcattggagcctcggggcatgacgctagagaaagacagcatggagggcccacttggcctgtccagatgaggatagacttttacatccactttagattgagtggaggagaggtccacaggggtgccttagagtagaggtcaacagacaagaatcctccgtgctcaaagtctgcctttatcttctcaaggatgcaagatagtgctgaatatgccactcctctttcccctgataccatgttgacaaaatgttcattcaattctttcaaaaaaatccaaacacagtaatcttcctgaggaattcagaattttcttaatttctgtctgacatccctgcctctctggggaggtagaggtaggaaagaatatagaaattgtccaagtctgaaagttggctctaaggaaactttatgctgcaaagcagacatgcaaaatctctcttgtagttgtcacaatgatattaaattacctactttattcatttatgaggctcaatgcgagcagcaaatcttagctggcaggccccaggcctgggctgttgagggaaacaggtggtatgtgagcacacacaccttgtcaaggcctttcttgatgtctcccagtggcctgagtcctcctatagggcctgcccaggcttcaggcctcactaccacttgctgcctgggagtacatgactacatggccctcactgttcacccagcttgagccatgctcttgcagatggaaaaagagcatacatgcatacttgacctctgccctgtgaggtaagcaacacagatatcaatagtcctgtttcacagacaaagaaattgaggcccagaaaggttaagtgattggtcatactcagctggcagtaatagagctgtgtcaaaactcagcttctctgactccaagctcagttaccttgccattctgcatgctgcctcctgaactggccatgaacactctttgaagaggtcatctcagagtgaggacacaagttggggtatctgtctccacagttcttccccattcactctgtgaatgcaaacatgaatttacgtttggcaaatatcagttaatatatcacttccatagataattgaaaattggctcttgcctgggtgcagtggctcatgcctataatctcagcactttgggaagccaatgggggaggatcacttgaagccgggagtttgagatcagcctgggcaacatgttgaaatcacatctcttcaaaaaataaaaaaaaaaatagtggggtgcagtggcacgtgcctgtagtcctagccacttgggaggctgaggtggaaggactgcctgagcccaggagtttgaggctgcaatgagccatgatcatgccactgcaccacagccctccaacctgggtgacagagtgagaccttgtctaaaaaaaaaaataaataaaaccgaaaattatctctcaaaattacggcaaaaagatgagacctctgggttagtgaattcaggagtcaaggggtaagatttttaagatgaatccagatatggcattaactttagtaggtgtttaaagaagagttacagccatgtgaataccctgctgtaagacctaggtgatgatgaaaactattgtaggctggataatggccccaaatctggaacttctaaatgttaccttatatggaaatagcatctctgcagatgtgaataaattaataattttgagatgaggatgttatcctcacatcttcatccatttgggtaggctctaaatgcaacatcatgtgtctttataagggggaggcagaaggagatttgacacaaatgcacagccctgggaataggagtgctacctagccctgccacttcctagctgggttgtttttggcaacttgaaggataggaatggaacataccctcttagagtccacaaaagttaaatgagaaaatatatgatggatggtaagcactcaaaagaagatggccattatcatctttctttattcgtgaaaacataagaactcttttcatatgtagtagggctgaataattggcccccatgatgctcacatcataatccccagaagctgtgaatatgttacctgacatgacaaaaaggactttgcaaatgtgattgacttaaggatcttgggatggggaggtcattttggattttcaggatttgccctaaacgtaatcaacaatgattcttctaagtgggatggaggagggttagagtcaaagaaggagatgtaatgacagaagcagaggttggagtgatgtggggtcatgagccaaggaatgtaggtatcctccggaaactagaaaaggaaaaaaaagaaaaaagatcttccccctagagcctctagaaggaatgcagccctgccaactcactccagtcttctgatctcaagaactgtaaaataataaatttgtgttggtttaaaccactcagtttgtggaactttgttacggcagccctaggaaactaatacatcatataaggtgaaagaagggtttttccttccattgtatacttgtcttaggcttccttctaaggaatgctaagcttgcgaggtaaggtggttaccttgtggtatatctttatatcccccagagttctgcaggacctgtccctgacaagatctctccaatcattattttcattcaatgctggtgccattgacccatctcagatccatattagctttctctaggactcttcaaacagaatcctcataggcctcctagacaagctgtctccatctcagctccatcatctatgcagtccccagcatgagctctctaacataccaagtctgccatatcattcctctgctcagaaacatccagtggctccctatcacctacaggatgaaacccagcaccacaatccattccaaccccacttacttcttcagccttctctcttgctatgcactgctatctgctttaacattaccagctatcctgaacctctccctcttccctttcaccattccatatcatcacacagtctgttccctccacttggccattctcagccatccttcaaacttcatctcccacgaaaaggcctcccccaactcctagcagaaactagggaactccatggcttgctcctggagcatgtgtccagattgtaccacaggtggctgattatgtgtctgtcaccctcatgtgaccatgagctaccggcaggaagggactctggctgattcattcctgcatcctcagagcaggtacttgcatgtgctctttgaattggccaattgctgaactagtgtttgtcaagtggaattacttagcatggatggcatcctgacacaatgcaactttgcttggcaccagcaaactgtcatcctccctgtctctcccatcacctctccagcaccaggcttcaggggctggcaactttatctgtgtggatgcccagcccctgtatgacactgtttattgattttagttgggctacaatcattacatctgttacccagctccacacaagggcttttaatagtccctctctttctcgaattctcagcttcagatctgtcagccacagaaatgttgctttccttctcttttctaagtccataccatactgatcattcattcaccactctgggagtctccgattttcccacatagccccagagaggcttccagataaaacagctatgacacaaagtgacagcaggcatgccaagagatacctatcatagcgcccggcatgttgtaagtgcttataacacaaatttctacggtagtaattcttcatgcaccagaatcatccaaggacttgttaaaaatcaaatttctgagtgccactccaagaggttctaaatcagtaggtcttcagtgggggccaagaatttgcatttctaacaagtttctgagtgatggagatgctgttggtccagggaacacactttgagaactgctggttttcagaatgagtgtgaataagcaaattaaagagaacttgtgaaagaaaaggcactgtaccacgaggcctgtggaatgcctactagttggcaaggaatgcacgtggatgctgaaggtagcagagagctcaggcagtagaaacgggatctgagaaatgcacatgggatggggggtgataggggcataggatacacagagaaggaagggcaggctcagggacaatataaagacactgggtgtctgtttgtatgtgaataaactggtatcttatagccaacgaatccactgatatgtggccaccatttctagattagctgcttggttacctacttcttaatccagctttagtcacagatcaaggagtctgcagaggagaagacaggctatgctagaaaaatatcaatgctagtaggaaagtggcatacaaggctgctgaattaggtgagctagatctagtgtcctagatgtctgttaatgcagggaggagcaaatataagcagacatttccataatttctaattggttcatttatatgtttacttgttcttatttcatttatgtctgttttggtacgtaatttcttagttttaaaaactagatgttatttttcacctctttgaggatactaaatgtatcttttatcaaatcatttttaggctgcaataatactttcactttgtcaagagggaatccatctccttagtgttgattttttttttagctgtcactcttcatattcatttttctcatgtgttttgggattttggcttagctcatgtagtagtatgtttgtttattttctctgccctcaccctttcctgtttagtgttcttgttattgcctccacctagcaccctagagctctcggttaaaaatcatgtatttgcttggtgactcaggcttccatcctgctgcgattctggggatatcaccagatttacaggtaacttgagccaagtcctggttgccaggatgtgtctgcttcatcttacatccctaagtttgcagctctgtgtaaaccgcagttctaatcagggggtaactgcaatgtttatacatccttttcatgaatgggaaagccccacactaggacttggtttcaagcagtaaatccagtgccttctcattaccccataggagcagaacacctggtcatctccatctccttctagatccagagcttagttgccctgtgccttcatccctgcttagcagatatatttatgttccaattttggtccactgagatacttatttatttatttttagggctgtatgcatttttctctttatagtacattcttgccatgtatttggtggaggtgtcttaaagtgtaaactttgaaaaagccatcttagccagcagtccagattggcttagttctcagttctttactagtgttgtttggaccatgaactgatttataaaaatttagattatattagtttctaggactgccacaacaaagtgtcacaaaccatgtggcttaaaataacagaaacttattctcacaattctagaggctagaaatttgaaatcaaggtcttggcagagccacattttctctgaaggctctaggggaagatgcttctttgcttcttctttgctcctggtggttgctggcaatccttgtcattcctagacttgtagacatgccattccaatctctgcctccatcttcacatggccttctccctgtgtccgtgtccattttctcttcttagaaagataccaatcattggattagggctcaccctaattcagtgtgacctcatcttaactaatgacatttgtaaagactctattcccaaatagatcatattcataggtttagggcaggcacaaattttagggggacactattcatgagtacactaggctatgaccctagaggcacgccctgctcctgactgaggcaatgggatattcacctcatctcctgattcccagctctagctggggccacttagctccccattaaatgctattttcaaaagtgctactggattatggaatgtgacttgctttttgtcagaattttggagtatcctaatagtgaatcagtagcataatctctatgtacatgggatggcaaatgatgtctgttcttgtaccctaaataatattcctgagtcttaggcaagtgctcaggtccagaaggacatgtttagttctttcagtaggtaacttgagaattcaaagttggcagaggaagtccagtaacatctcatttatctagcattgtcaggctctttgtcgttataataaatgatcccacatggctgaacctcttgcattcgaacctactttgtataatattgctgcttcctctgtcactgtcagtggccatttgtgatgtctgccagcctcacttccagtagctctggccctctctttctaatttgctgcttctatgtgctacaggctgagagaactggcagcagagcttgctagacatgtgggcgtgaagccacaaactgcatatgaacctgccgagctccctggtgaaggaagggcaggagacttcaggctatttcagctcttcagacgctgttctgaggttgatgactttctgattcagttaggtcaccaattacatgattttggaataattgaggtattactgaactgtatagaaactactttttgaaatctgtaggtttcacagactttatttggcctgagcacccatttgtgccactggagacctggaagggtcagagtgatgaggctgaggccagctcacaactcaggctctttctgctgctccatcttccttcctcctgcctcattcagtggtttcctccaagattcctagggcagagccagagctccaggcactggggtccagacagcagggcaggaaagttccgggggacaccagagagagtatggcgtggaagagagaagatcttagagtcagccagacctaagtttcaatagccactcttcacttagtagctgtatgacttaggtgaaattatttaactctggtcttgacttaaatacctataaaatgaggataataataacatctaccttgtggggatgctttttgtgtatcaattaaaacaaagtggtaaaaatgttcaatgtattgtaggcacccaatggtagcccagcattttcattgttggatgttagtcttctgctcatccatttattcagcatcagaaaatacacagcagtaccagaaacacacatgcactttatgtcctgctgagagattgctaataagcactagtcctcagcttcctaggatgtggaatgagtcagtaatataactggaggctttaggacagtaggcagatgtggcctgtccttcctcactctgcctctggctctctttctccaaactctaagtctctggaggctgtaggcaacaggcccagattggaagctcacccctctccagtgggcccagggggaaaaaaacctccaagctcaacatcttgcaattactgggaagaactgggcacagctctgtattctctaccctttgaagaacttcctaatgaccttcagaagaagggaggttccttcccctacattccccacatctcagtcagggtctcagcaaatagatggataagcagttactgctgcagaagggctaacatgaggattctaattttggggccacactgctattcagaatctgcagccatttgagcagcacttttaatgttttcaaagtcctttcctatttttttaaatatgacccccattttagcgatggagaaatgaaggcagtgactgaggcagagagggaggaggacccctgaataaattagcagctgaggtggggtcaaagccctggtttcttgcttcactgagccctttctataccatgtgggccctatcagttaggaatcaaagaaccagaagaagacaacaagcctgtccactatcccttaagtagccagcctgagcttccttggagaccccaagaacacaagacttcactccaaggacaagccaggacttcactccaaaggacaggccaggatgctggggtggggggcaatgtcctcattctagttttgtcactcaaactctagaacaattgatagtatatttcctgggctcagctcattggctatgtgtggagagtgggcctggagaggaagtcaggggggtgtcaagggcagaggtaggatgagaacccttcctctctgggtcattcacagggcacttatacattctgacctgctgtggtggcctttaagatcgtcatcttccccatctgtaaagtgggtataacatcattgtcaactgccttatggtggctgttagaaggctcagaggccattagggatgagtgagtgatctataaaggagaatcagtatctgacttggctactcattctaattcatagggtggctactaggggacagatggtgagctaagtattgtgcatgaatcatccccaaatagcccagtgacagaactgatatgagagccttttctgaccaattccagaggcctaaaaaatgagctggaagtcatactgctatgtgcataagactgtcatattttgcaaacaaaaataaaggactccactgacatttgaatttcaggtgaatgattaacaatattttagtataagtatgtactgtgcaatatttgtgacatacaaaaattattcagtttatctaaaattcaaatttaactgggcatcttgtaatttatctagcaatcctatgtgtacatggagttggcattgcaggggcagcaggtaggcaggctttttgtttgtatattcattttgaagcaagggagttagcagtccatatactagtagagaaattatcttcccaccaaaacaagtcaccactgctgttctcaccttgagggccaccatgaacatatacaaacttgatattgtgtcctgaagaaaaaccttcacctaagcttatatcctgtcccttctcttttcttcctgaatgttcctacgaccctacttttccccattcatctgggctcctttggggaatttaaaaaatattttatcaaggataaaggggatattttaaaaaataaaggttatttttgcatgtttagcatttgagtccacctaaacatgaagttcatgatgtttaaagatatttgtagccttcctttctgtccaagacagagtcacaggggctgaatttatcctacagcttgaaacaatcaacaaacaaacaaacaaacaaaaaagaaacaatactttgcaagattctgggcattaggtaatgcaagacagtgatccttaatacatgggaaacaaatgaggcaagtgctacaattgccccagcttattgcctagagagagatttaaggctgtggaacagggagggaaaatccaggcagagtttgatgctctccctgagttgaagatatggctgggaatccaggaaggccaaggaggctaactttacaagataggtattgtaaaactgcacagaggggacattttggcgacccactgagggtctcccttgagtattcagtgtagtaatgatcagtgaatccatgtgaaggaactacctaaggcctagaaaagaactacttgaaagaattatgagtaacagtacctgtaacttacacaactcaggataatgcctgcttctcccagccagtctggaaaaatctcagattcacaacgtattgagtacagcacacaaatgaatcttatctcagtattagggaataattagctctagactgataactgcttcaatcctcctaacaaatcataaaaggaaaacctgagaggttcaagctatttccaagtaacttaactatgctccagaacaaggctcaagaatattcataggaatacaaaaatatccagcaccaaatagggcaaaattcacagtgtttgtcatccaatagaaagttaccaggcaaacaaacacaaaagcaggaaaatatgacccacaatgaggagattgaaaccaacacagaattgaaacagatgttagaattagtagatgaggacattaaaatggtaattataactgtattccaaatgttcaaaaagttaagtagagacatgtgagatacaaaacagacccaaattgaacttctaaaaatgaaaactataatgtatgacacaaaaatacactggatgggaataatggaagattagacattgtagataaaagattagtgaacttgaacaaccactaataaaaattatccaaatgaaacacagagagaaaagatataaaaaaagaacataattgaactgtgagagaacttcaaagacttaatacatgtgtaactggagtcatgtgaaggaagggaagaggcagaaaaatattagaagaaataatgaccacaaattttccagatttcgtgaaaactataaacccatagttctaataatttcaataaaccccaggtatgagaaatatgaacaaaccatacgaatacgtattataaaaaaattgctcaaaactagtgataaacatcataaaagcaaccaaaggaaaaagacatgttatgaacagaggaacaaatataaggataatagtaattttggggggtcagaaacaatgcaaagaagaagataatcaacatctgtaaggtactgaatgaaaaaaaacttgtcaacctcgtattttatacccagtgaaactgtctttcaaaaatgaaggtgaaatacccaggagtttgagaccagcctgggcaacatagggagacctcatctctgccaaaaaaaaaaaaaatgagctgggtatagtggtgtgtgcctgcctgtagtctcagctactcgggtgctggggtggaaggattacttaaacctgggaaactgaggctgcagtaagctgtgtttgttgtttgtgttgtgccactgcactccagcctgggtgacagagtgaaataaagacttttagcaacagacctgcactgcaagagatgctaaagaaagtccttcaggcagaggaaaaatgacaccagatgaaaatatgtagctacacaacgaaatggagaacactgaaatggtaatgacatggatatatatatagaattttttttaacttttattttaagttcaggggtacaagtgctggtttgttacataggtaaacttgtgtcataggggtttgttgtgcagattatttcatcacccaggtgttaagcctagtacccattagttgtttttcttgatcctctcccttgtcccaccctcccctctctaaaaggccccagtgtgggttcttcccctctatgtgtccatgtgttctcatcatttacctcccacttgtaagtgagaacatgtggtatttggttttctgttcctgggagtttccttattatttaaatttctttaaaagataattgactatttaaacaaaaataataacaattgagagtggaggttataacataagtgaaattactataatagcacaaaagacagaaggagagaaatggaagatactgttatgacatttttatactatatatgaagtgacataatattacttaaggcagattgtgataaattaatagtatattctgtaaatctgtaatgaactactaaaataacaaaacaaagagtaatagctaaaagacaaaatgaaattgaagaaatattcaattaatccaaaaggagtttaaaaaataaagagaaaaaagggggagcacagaatatacgggacaaataaaaagcaaacagcaaaatgatagatttaaatctgataatatcaacactcacactaaatataaaatggtctgaacagcacaataaaaaggcagagactgtcacactgagtttaaaaagcaaaacctgactgtatgcttcctacaataaatgcatttcataaataaagatacaaatactttaaaagtaaaatgatgaaaactatgatgctaatactaatcaaaagaaatctgaagtggctatcttaatatcagataaagcagatttcagaataaagaatattataagggataaggtcatcccacaagggataaaggtcattccataatgataaagggatcaatttactaagaggaacataagagtttatgaacctaataagagagtttcacattacacgaagcaaaagctaatataatgcaaggataaatagacacatacataattaaagttggagatttcaatattattctctcaataattaatagaataagtagacagaaaatcattaaggatatagaagatgtgaaaaacactactgacaaacttgatctatttgacatttatagaatagttcatccaatgacagtagaatacattcattttaaatgtacatggaacatttaccaatatagacaatatttggtgccataaaacaagtttcaataacattaataggattcaagccatacacaatatgttttctgaccacaatagaattaaaatggaaatcaaagacaaataactctggaaaacttccaaatatttggaagaagaaaacaagaaaacaggttctaataactgttatttagttaccaaatattcggaagaagaaaacaaggaaaattagaaagtattttgaaccgaatgaaaatggacacataacatatctaaatttggtgtatgctattatattaaagcagtatttaggggacactttatggcattaaattcctataccagaaaaaaaaagttttaaattaatgacctaagtgtccacgctatcaatcattgtggaagtcagtgtggcgattcctcagggatctagaactagaaataccatctgacccagccatcccattactgggtatatacccaaaggactataaatcatgctgctataaagacacatgcacacgtatgtttattgcagcattattcacaatagcaaagacttggaaccaacccaaatgtccaacaatgatagactggactaagaaaatgtggcacatatacaccatggaatactgtgcagccataaaaaatgatgagttcatgtcctttgtagggatatggatggagctggaaaccatcattctcagcaaactatcgcaaggacaaaaaaacaaacatcgcatgttctcactcatacgtgcgaattgaacaatgagaacacatggacacaggaaggggaacatcacacactggaacctgttgtggggtggggggaggggggagggatagctttaggagatatacctaatgctaaatgatgagttaatgggtgcagcacaccaacatggcacatgtatacatatgtaacaaacatgtaccctaaaacataaagtataataaaaaagaaaaaaaaaaaaagaaaaggaaagcggccgggtgtggtggctcacgcctgtaatcccagcactttgggaggccgaggcaggcagatcatgaggtcaagagatcgagaccatcctggctaacacggtgaaaccctgtctctactaaaaacacaaaaacaaaattagccgggcatggtggtgggcgcctgtagtcccagctactcgggaggctgaggcgggagaatggcgtgaactcgggaggcggagcttgcagtgagctgagatcggccactgcactccagcctgggcaacagagcaagactccatctcaaaaaaaaaaaagaaagaaagaaagcaaattaaacccaaagtaaatggtaaagagaaaataataaagatcagagcagaaatcaatgaagttaaaaacaggaaaacaaagaaaaattattgcaacaaaaactggtgctctgagatcaacaaaattgatgaagctccatccatgagtgttgttctcatcatttagctcccaaagagataagatacaaattactaatgccaggaattgggaggtgaattcaccatagattctacacatataaaaagaataagatactatcataaaaacctttatgactttatgacaatacatttagtgaattcgacaaaatggacccattccttgaatgacatatattaccaaagctgactcctgaagaaataaataacttgaatagttctacatctattttaaaaattgaatttgtagttaaaaacttatccatacagaaaactccaggaccagatggcttcatgaaatatttaaggataaaataaaactaactctacagaaaactctcccagaaaatgaaagagctaattctatgagactagcattatactgataacaatgccagaaaaaaaatattataagaaaagaaaactatagactaatattcctccctcatagaagtaaatgaaaagattctgaacaaaattttagcaaatcaaatccaacaatacataaaatggataatacaacataaccaagtgaaatttatctcagtaaggaaggttggtctaacatttgaaaataaatcaatttaatttaccatactaacaaactaaaaaaggaaaaccatattatcatcttaatggatatcaaaaaagcatctgacaaaatcgaacacctatttataataattctcaacaaactttgagtagaacttcctcaacctaacaaagagcagctacaaaaagtctataactaacgaaaacttaatggtgaaaaaatggaaagctttccccttaagatatggaacactgcaaggatgtccactctcacctcttctatccaacactgatttagctagagcaattagaaaagaaagaaaaaggccgggcgcagtggctcacgcctgcaatcccagcactttgggaggccgaagcgggcggatcatgaggtcaggagattgagaccatcctggctaacatggtgaaaccccgtctctactgaaaatacaaaaaatttagccgggcgtggtggcgggcgcctgtagtcccagctactcgggaggctgaggcaggagaatggcgtgaacccgggaggcggagcttgcagtgagccgagatcgcaccactgcactccagcctgggcgacagagcgagactccatctcaaaaaaaagaaaaaagaaaaaaaaaaaagaaaaaagaaaaaaaaaagaaaaaaaggcaattaagattgaaatagaagaagtaaaactgactttatctacagccagtatgatttgtctattcacaaccaatatgaatatctatgtagaaaaatctgatggaatctacaaaaaggggcagtaagtgagtttagtaagattatgggatataagatcaatatacaaaaatcagtttcattcttatatactacctatgaataatcagaaattgaaataaaaattaccacttaaaatagcatcaatgatacaaaatacttagggataaacttgagaaaagatgtaaaggacctctaccgtaaaaactataaaacactgctgagagaaaataaaaagatctaaataaacagagatatactatgttcacagggcaaggatttaacattgttaaggtgtgaattttccccaaattgttttgtagattcagtacaataccagtcaagattccaggacgcttttgagtagaaattaacgagttgattctaaaattcatatgaaaatgcaaaagatctagtattgctaaactaactttgacaaaagaagaataaatttggaagacttacactacctgatttcaagatttattatacaacatagtaatcaagacacagtgatgttggtatcaagataaatagatcaatggaacagaacagagagtctagaaatagacctgtacatatatagaaaactgattttttatttatttatttttgctgggcacaatggctcatgtctgtaatttcagtgctttgggaggccaaggcaggaggatcacttgaggacaggggttcaagaccagcctgggaaacataaagaaacgccatctctacaaaaattttagaaaattagccaggcatggtggtgcatacctgtagtcctagctactcgggaggctgagtcaggagaattgcttgagcccaagggttcaagattaccatgccactacactctagcctgggtgacagagtgagatcctgtctctaaaacaaaaacaaaaacaaaacctgatttttgacaaaggtgcaaaggcagttacatggagaagtgacagtcttttcaatcagtggcactggaacaattggacacccttgtgcaaaaaataaattttaatccctaccatacaacgtatacaaaaattgactcaaaacgtatcatagacctaaatgtaaagcttaaaactataaaacttctagaataaaacattggagaaaatcttttgcaaccttgtgtttggtaaagattctttagacaccaaagtgcaatccataaaagaaaaagttggtaaattggacttcatcaaaatataaaatatctacttttccaaagatacagttaagagcatgaaaagacaacccacatagaccaagagaaaatttgtgcaaataatatatcctataagagacttgtaactagaatttatgaagaagaagttgtagtttggcagtaaaaagacaacacaaatttaagatgatgggcaaaatcatgatggacatgatcatcaaaaaatgtctattcgaatagacaaaaactgtctattcaggaaatggaaatcaaaaccccactgagataccagtttacacccactacaatggccacaatcaaaatgatgggcaatagcaaatgttagcaaggatgtggaaaaatcagaatcctcatatgttgctggttgaaatgtaaaatggtacagacactttgaaaagcagtctagtagctcctcaaaaggttaaatattactatatgaaataccaattccactcctaggtacatactaaagagaaatgaaaacatatgtctacacaaaaacttgcacagaaatagctgcattattaataatagtcaaaaggtggaaacaagtccaatgtccattgaatgatgaaggggtaaacaaaatgggatatatccatacgatggaatattattcattcataaaaagaatgaagtactgatccatactacaacatggatgaactctgaaaactttatgctaagtgaaagaagccatttgtaataggccacatatggtatgattccatgaatgtgaaatgtccagaataggcaaatcaatagagacagaaagtagattagtggttgtcaggggctaggggagatgagatggagagtgactatttaatggatacagggtttccatttgaagtgatgaaaatgttgtggaattagatagtggtgatggttgcacaattctgtgaatacactaaaatcactgagttgtatgtacacttttaaagaatagagaatttttaaagggtgaattttatggtatgcgaagtatacctcactaaagctgttatttaaaatagaaaaaatgactgttctatttttgattagctctttggacctttcttggtttttcatagaatctttagacaatggaaatgggaagtaagagggagggagagtaaaatctcagtttcattgtaaggagtgaccctgtggagtggacatgtggtgttttatttatttatttttatctgtaaaagagaccttttattaaaacaaggagcctgaggtacagctcatcagagtggattcagctgtcggaaatgcaaatgcattgacaactcaaggcttcagcttctgctaaactcaaactggctggacagtgtaagatgtacgtccagcactttcaaagcagtgtgtagagggaaatttatagcactaaatgcccacaagagaaagcaggaaagatccaaaattgacaccttaacatcacaattaaaagaactagaaaagcaagagcaaacacattcaaaagctagcagaaggcaagaaataactaaaatcagagcagaactgaaggaaatagagacacaaaaaacccttcaaaaaattattgaaaccaggagctggttttttgaaaggatcaacaaaattgatagaccgctagcaagactaataaagaagaaaagagagaagaatcaaatagacacaataaaaaatgataaaggggatatcaccaccaatcccacagaaatacaaactaccaacagagaatactacaaacacctctatgcaaataaactagaaaatctagaataaatggataaattcctcgacacatacatcctcccaagactaaaccaggaagaagttgaatctttgaatagaccaataacgggctctgaaattgaggcaataatcaatagcttaccaaccaaaaagagtccaggaccagatggattcacagccggattctaccagaggtacaaggaggaactggtaccattccttctgaaactattccaatcaacagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaaatgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcacaagacagggatgtcctctctcaccactcctattcaacatagcgttggaagttctggccagggcaatgaggcagtagaaggaaataaagggtattcaattaggaaaagaggaagtcaaattgtccctgtttgcagatgacatgattgtatatctagaaaaccccattgtctcagcccaaaatctccttaagctgataagcaacttcagcaaaatctcaggatacaaaatcaatgtgcaaaaatcacaagcattcttatacaccaataacagacaaacagagagccaaatcatgagtgaactcccattcacaatggcttcaaagagaataaaatacctaggaatccaactcacaagggatgtaaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcgccaaggcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgacaaaaacaagcaatggggaaaggattccctatttaataaatggtgctgggaaaactgactagccatatgtagaaagctgaaactggatcccttccttacaccttatacaaaaattaattcaagatggattaaagacttaaacgttagacctaaaaccataaaaaccctagaagaaaacctaggcattaccattcaggacataggcatggcaaagacttcatgtctaaaacaccaaaagcaatggcaacaaaagacaaaattgacaaatgggatctaattaaactaaagagcttccacacagcaaaagaaactaccatcagagtgaacaggcaacctacaaaatgggagaaaattttcacaacctactcatctgacaaagggctaatatccagaatctacaatgaactcaaacaaatttacaagaagaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttgctgggactgtaaactagttcaaccattgtggaagtcagtgtggcgattcctcagggatctagaactagaaataccatctgacccagccatcccattactgggtatatacccaaaggattataaatcatgctgctataaagacacatgcacacgtatgtttattgcggcactattcacaatagcaaagacttggaactaacccaaatgtccaacaacgatagactggattaagaaaatgtggcatatatacaccatggaatactatgcagccataaaaaatgatgagttcatgtcctttgtagggacgtggatgaaattggaaatcatcattctcagtaaactatcgcaagaacaaaaaaccaaacactgcatattctcactcataggtgggaattgaacaatgagaacacatggacacaggaaggggaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacatgtaccctaaaacttaaagtataaaaaaaaaaaaaaaaagaagtgtgtccaggtgaaagcagctttggctcttggctggtggagtgggagggaccttagagccatgtttctctgttgcatttactcagcttatccatctctgaatcaaagcacacaagtctcttgaaaaacctaagaggtttttcatttcaggacaggggtggccaaactgtgtagcagagagtgagtggtggacttgggttagagtcccagctctgccacctgtgagttgggtaaccttgggaaatttacaagcctcagttttctcatctgcaaaataggaatagcacatttgcaaagttgtctacagattgccccaggagatgtatgtgaaagtgcttgacaatgcttgttggttgcatttgtatctgaaacttctggtagaatcattattgtaacatccctaaatagcaagtttaaatcggtataaaccattaatgtccctacacagatggcacatgccagagtaggatgtgaatactgacatgggcaccatttacaacagtaagaatgtattgcacatgcactgtagagcaggctcttctggcacattctctagtttcatccttgcaacaaccctatgaggtaggtcctgttagtttccctttatacgaataaagaaattgagactcaaagagcttagatgatgtaacttaatggaaggacagaaattgccaagtgtttcaacaggaggcagaagacagcagtggttaagcgcctggcctaactgaatccaagctccagcacactatctgtgtgacctggggcaatatgcctctctctgtgtgtcagttgtctcatatctgaaaagggataacaacagtacccacctcggtgggtgctataaggatgaaatgagtcaatattcacaagacatagagaatattgtctggcactggcacagaatgttagctttgattaataattcactataaaataatgtaattgttagtgaatcatcaatctaaaatgttaggttgctgaaactgacattatctaccagatgatacttctctgctcactatttagcagttgctctatattgggatttgtttgggatgttggcatattttataactttctaggtcaccaaaaattgcttcatcctcagagcataggctagtcacccccatctaggtaaaaccctcttcatgccacctctgtagaatctggggcccagagagtccaaagaacctgcattacgtgacatatcaaatgtatgacaaagctcagactggaatccaggtctccattagcctaagcctatttgagagccaggagccaggtctaggactgggagggatctgaggactgtcagactgcagtgagtttcccccaggatttggtgaaggtcgtgagacattttcccaagaaagatgtatgatgtttgccttggttctttggcaatctcacaataggaaatgttctcatggcacttctgagaatattttcacacaaggacagagatagtaaatatctgactgatagagaaaaaggggggcaataaatcccttctggcacatgttcattgatgagaaagatgctttataagtatggcaattgcacagatgcatcatggtatgctgagggctggctaatgtgaacagagggaggagtcccatctttgggctgccactgttcctcagggagccacggaggtaggaaaatgttgttttgcttccctccccaggaattctgtttcaacacacaaggttgctgccaacctgcacccttcactttctttccctctctgggcttcagctcctctgccttgacctgggcccagtgacttgggccctgactcctcccagagctggcggctaggaccagggagccagtgaaggatgctcttggattctgagcctgggatgaagctggccactgtgatagggctgctctgagttcaccttccactttatctgccagaaggccagtatcttcttggtgtgacaggctgaggatttggcagtgaagggatcacagatccatgaaggtgtggtctccccagtgccagctctctgggcctcctgcaagctgggctccatcttctagcaccacactgctgacttctctagaaaaggaccaggagaaaagggcctagtgttagagcaagagcgtttgggttctagctcaggtgccactgtggacattgggtgagccagagcctgccacttcccagggcctcagccacccatctgtaaagcaaagggggttgggggaacaaaagagccccaacaatcctggaaagtgagagcagcaaaaaatcttagcagtcatggtacttgtcattaaaagatgatgaaacttaggctcagagaggtgagagacctacccaaggttattcagggaattagtggctgagtgggacctgggctctgggttctgtcccggcctccaggccaaccacagcagtctgcactgcctctaaggtctcttcccattggaaaccctgaggactcatgtgtgcctgctctgccccatggggaggccttcctttggagcaatggcctccagctgacctggacagggccactgcatagggggagtcatctcctcaggagcaactctccagggctgtcttcactgtgtcctggaagtagactggctgggactcagagtcagtcatattaaactctccaggctttacccagaccagggcttgagccaagcagggagtggcagtggattttttccacctcctttctctttgtataaatacacccacttcagccaaagcctgcatgtttggcttctgaggttggctggcccctcctgtcagcttgcttgctctcctccagtctgtctcctcttggttgttccatcccacccccaccccgccacctacctgggttcctcctgctccatcaggagatggaggcaggctgtgctggcaccagctggggttccaagggggccggggccccaagcaggaacttgggtcctagggcggagctgaaatcactgctgcctgagcagatatcacagcaaagaaagcagcacggtgtgggggagccatagctgtagggactgggccacccgagtaacctggggcagcacacaaggcaggtggtcagaggcaatctggatccacaggtagctccactccacaagaatgtgtggggatgcctctatgtggggatgaaggctgcatctacatgatatgaggctcttctagtggatgtgggctgcatctacgtggaatctggctccctaaagagatacagacaacatccatgcaagacaaaacttcccaaggaaaacagggctgtgtttccataggacaaaactgcaaagagatgcttgctgtgtctgtcaagtccagccctgcaggcagaagccaactgcacatacagagccccgatctgccacaagaggcagacggtaaaagtggaggatagcacccagccaggagatgcgggcagcaccaacatgaggactgtgggtcttcccagtgatgcacactgccactgtgtggatcacagctctgcagaaaaatgatggcagttccctggaggcagaggttgcattagtcatgaatgtggctcttcaagaccccccatggatccatgtggtgcacagctctgcatggtggtgctggctaggtcaggaccaagtgaaatttcataaggcaatgcaggcatatctgtgcaaggaggctcagtggaaaggtgcagacaacatctaaacaagatgagcctcggcaggcttctgcaggccatggccacacaggaggtgactttatacccagatacaaactgtctctacaaagaacacagttcagtaagcaagctcaagcctcatctacacagcacagactccacaagaggatgttggctgtgtcaacagctgccctgcaacaggccataaactgtgtctacatgagcaaaaactctgtgtgtcatcacaggctgtgtctgcacagaaccaaactatggctgcccaggacaaggtgggacattcccaagatgaagctgcacctgcccaaaatgacgctgtgtctacccaagatgaggttttatctgtcaccaagaaggctgtgtaagcacagaaggaggctatgtttactgagattgagtttgcatctgcagataaccaggcagcgtctacacagaaccacatagcttgcacacaaaatgaggcttctcaaggaacttccacctgtatccacacaggacaagcccctgtctgtggaaatgcatcaggctatcctgtggagatgcagcccacatctacagtgtgcatggctccagcaggcaccaccacctggatcagctcagaaatgccctctgtgcctaattacagccagtacagggatgagccaggactgctagtggatacgcagcctgtgtctacatggagtggagcgcctcactggaccagcatggagtaatgctttgcaagtagattcaaactgtttattgaagaactggggctctacctgccagtgttgcctgcctctacagccagcacccagagaagtggagaactagccactgcaggagaaaactggttgcacctaactggggatctttgcagagagtcatcatgtgtccacaccaagtgaagctcctcatggaactgcagtctggtgagtgaaacagaaagagttgctgcaaggggttgctggctgcttccacctgatccaaggaccagatgcaggctgaacctacacattgactgagtacagcaactcaaggaaacagcctgggttggcggagcagaagtagatgacgcaagagtttgctggctgatttcacctgaggcacagcactagctggaggctcagcccatgtctactttgagcccatctcagcaaggagctgaatctgggctcagtgggcctctaccagggcacaggctgtgtcttaatggagcagaggtctatgtgcaggaccaatctgcctccatgcccaccatagtgctgctaagaaacaacccaacaaacttccctgtggggctgctgtcagtgcctcactagagcagagctccaagcacaggcacagaatgcacctacatgcaatgcagctgggccactcttgagccctgctcccttgcacccccagccacaggtagctagaagagcactgccagtgtgtgcagccttgcccggtaagtgcgagtttgccgtgccctccttctctccaccattgcccatagggctgtctccaaggcacctgactgtccccaaggcaccatgcaggtcctgtctgctgggtttcagaagcctggcatttctagatttggacagagtcccacatatacaccagggtatagagctgattcccctgtgcaaacccatctgcaggtcttaatctgtaaaaagtcttcctaataaatctgaaaaaccgccagtgcctggttctgtttccgtctggttgggagattctggattcatagccatatggggaggagctgactgtgtggggcctcaaatcctgggcagcgtctgaacagggatgggaaggatgatgatggcagggttcccaggataaggcactccatgaagcaaggcccagggacaggacaacatggactatttgagggaaacagcaaggcatgcatattttctgaaatgtggttggttgctgtctcctgggctccctcagcatgttgtatgtcgcttcatcagcatttgtctccctggtttccgttgctagctcctcttctgttgctctgctctcaaaggtcagatctctgcacagggttgccccagccctctcattacataccccccagcaatcccagcaagacccagggtttcaggtaggtaccatctacagtgaatcatctgcaatgatggaaatacttcatatctccatgcccagtacagcagccaggagccatgtgatatccattgagctactgcatatataattagtgtgactgaggagctgaattttaaattgtaattaatttatgttttaaaatctctttcctttttaaacatttaagtatttatttatttagaaacagggtctctctctgttgcccaggctggccttgaactcttgggctcaggcaatcagtcctcccacctcagtctcccaagtagctgggactaaaggcacgtgccactgcccccaggtaattgtaattaatttaaacttctgtcttttctgtgtttaattacaaaatatatagaacataaaatttgccattttaactatttctaagtgtacaattcagtggcattaattacactcagggtgttgtgcaacgaccaccactatttccaaaacttttcatcaccccaagcagaaattttatactgtgctttttaaaattaaaattaatttacatttaaatagcaacgtggctagaagtcaccatattgaacaacacaagtttagtagtcaataaccttcaaattagcatctccaccctagaccctccctctgccctgagccccagtcctggatacccaactgtctagtgggcacccttccacctgagtgccctattagcacctaaaactctatctttccaaaatcaaactcattgtctccacccctacattcctatactgctccttctggattccctgtcttacaaaatgacaccaccggccacccaatggccggtgagtcagaaacctgtgagtcatctcaggtgcttcccatttactttgcttccacagccaattattttcaagctctgcagattctgcctccttgacttatctcgacttggccccatcttctccttccctattgccattcctcaggcgtggattcctactccacactatgtgaacttgactctgcctcctcccatccctttaccaccatgcctctgtccctcaacactggaggattggcagagcagcaaggttttgttattcaggtgctgcccaacctccaccctacccccagtgcaagagcccagctctctgggaagaccaagaccttatcaagctagggaaaaccagaacaaaaaaagatgaggaggttatcatggcttctaggagagagcccaaggccagccaggaagcagtgggagcagtctccctacatgagggaccccacagattgggattcaaatcctaagtctgcagctaaaaagatgcctcagtttcctcatctgtaggatggggataattattttccaccctttactgtgctgggaggattaaaagaagcaatggagggagaggggcgaaaactaccaggtcagcttccttaggggcagaagttactggtcccagctcacagaggaggcaagtggatggggaatgttatggcaggatcttggaggtcattccaagacactatagacttgtccgccggagttcagagaaggagcaaatgccctcctggaaaagtggccaagtgaggtcacttacaacttcatttccagagttgccttgccaagaccccagtgttccctgggcaatgccagcttggctgatgggcaagccctcccagtagggaggcttggcctttgttactcttgatcctggggagttgaaaggggaagtgggtgcctgctgacagtgtgctgcctgctgggccctgggtgtgcccacatggtggctgctgaaggactgctttctcccagtgcctggcggtcattcagtcattaagaaggggtaaaaattttacttggaaagaaatagagaaactctgcttttgagaaagtgagtcatcagcactaaaggtctagctgaatcttctgatagcagagatagtttttttttttttttttctgtcggttaatgatgtaggcagtgagcatagagagcatcacttctgccttgtttagtgaaaattcagctattcccaaggccagctcttcagggggactgcccttccctttgggggtcattggacaggacacacaataggcattctttcctggagaagggtgggggcaggacatgtggccttcactgagatgggatgcagagcctctccctggccaggctacaagggctcctgttttgaatactctgtcctgggctgaagtgagcagtagtcaaaagccatacctcaaagctgagacctgaactgagactctcccagaaaacacctggggcctggcaaggtatttctgcaaatggagttgtatgtggcctcatttggccacttccccaggggtcatgcagccaggcagcagggagacacaactaatgaacaagccctaaatacaggctcccaggttggcctggctgtggggcccttagacatgacttgtcatcattttacagcaagggaaactgaggctgtgaaaacagagacaccttgtccagcatcatggcacactacaacactcactgcctctcccatattgaataagggcatggacccttccttgagggtttgaaagagggctcttctctaagccagtgtctaattcctacataaaaacccaatctcaacacaattctgtacccaaactgcatatctttaatgtcttcatcctgaaggtgcagtgatcctgggccctgatggggcaaggagacataaatacatgttttgaagcagaatgcatagccctgcatagaactctggatctttccaaatattattgtgccttctgtgggggtaatgtagcccacagggcagagttccctgtgactttccacagaaatctttgctgacataaaaatagactgctcagacatttgaatgcagagttctcactctccttctaaattggggaagtcactctaacagagtgttagatacatggtcatggaaaaaggatgcgagggaggaggaagagcagggggcaggaggcctggctccttctccaactgtgattccaaggcctgggcttgagttgatggcctggcaactgggctgttaattacgtgaccaatcaaaagatactcccaggtaggggcatgccctgtggaaacacgactctagtaatagagcattaaagattttagaaaccataaatttcaaccatccacccacccccattttataaatagaccaattgaggttgagagattcatgtaagggcaacatatattttctgaccatcttgacactgacagccacaaccgagtgttctttctcctacagaaacattaaggctatcactataccagtccctgtatgctttcctgatgagtcaagcaacactcccaacttggagctttgtgttctctctgattgcaagcatacctgggataagcactccaaacacatgggactcattcccagggtcaagatgctctctttggtctgtacttcctggtaaccgcatttataaacctaatgcgtcagagtgctcatttcaaagaccatgtgctcatttcaaacactacccagggccttggcttgcacttgggcaaagcaggcacttggtaaaattaaggttggtagtatcacatccaaatgctgagcaaattaggcagactgtacctgacagggagaagcctgactgtatccctcaggccagcatcctgcagggatagaaaagtactggtgactctgcctgcccttaccctagatgcacctcaagccatgaggggtctgatgatcagtttgtctccaagagaagatgactcttgagctggagttcgcaatttcttctcttgtcagttctattgcaattagtggattctaatcataggcatacatgtggaaaaggaaggggacgtaagggagagaggaaacagctcatccttccccaggtgcaagccaggacagcacttatgctctgatggcaaggtcccgctgcagaagcccacatacacctgctgtccttcacttgcccggagcccctgtggcagcatcagctgccagcttggcccaccctgcttgtcccactgcttcagctcagaagacgtctgtgtttggtggggggttggagaggtgagggtcaggagacaggaggagcacagaaaccggcttcaaacagccaaaggcctttcatgtgcagaaagagggaggagattttatctgaatgatatttagggccccctcactggctgatggaagctgaagccagagaggcctgtttctaatcacatatctcagagagaagagaatttctcatcatgggggtgaggtcaaggaaaggctggacaaccatctgtcagggattgcctgccaagggtgggaggccaagggcagggtgctatggggcctgtccactctgggacgctaggatttctcagctccccaggccagagccagccttgtgacccgctgccatttcttggcactgtaccccccagtatgaggtggggtttccatgcgcctctgtaagccatctttccccaagtctgtccactggcctgccatggctccctgtgggatggcggctctacctggatccatacaaggatggggatggaggtttctattccaggccctcaggggaggtagtctgggcctactttgtgacatgtaataagaaccagaacaggctctaaaggactccataagcttaaggcagctttggggtttgcagtcacagtgggaactttggacaccatggccttgagaatatcagattgatctggagcctgtgccacactggggacatgctggtgacaatataggcaagctgatggtcttgtgggcaggtttgttaaactatagggatgccatccttcgtactgcactcttctctgtcctctgaactttctggacaatctcctctgctgaacctcagttgtgctcccacctctccagctgtgactgcccttgctccccccatcacccaccccaggatgttgactgtcatggtggaaacctactttcttactttatgtcttactttcttttcaagtagtacattttggttttagtactctgttcaccagaacttaccttcttttttcttctcttgtcatcctatgctaccaagggattggacatgccttggtacccagcctgaaccaggcatgagatgccttgtttctctgacatccaccttcttatccttgagtttatgtatgactctagcaggctgaataattggccttcaaagatgtccccatcctaagtctccaaacctgtgaatgttaccttatatagcaaaggtgaatctgcaggtgtgatttggttaaagatcttaaaatagggagattatcctggcttttctgggtgggctcagtgtaatcacaagaatccttcaaaggtttaagagggagtcagagaaggagatgcgatgatggaagcaggggtcagagtgatgcggcacaaactaacaaatgcagtggcttctagaagctggaaaaggaaagggaacagcttctccttgagagcttccagaaggaacacaatcttgctgacaccttgattttagcccggtgaaattcattttggacttctgacctccagaagtataaaataataaatgctgtgttgttttaagccactaaagtgcatggtaattttttacctccagcagtaggaaactgatacagctgctaatggtgtttaaacaagaaccagagacacaatcgccagctgtcactggctgaagcaatgtgctatagaggacagaatgggcaggcaaccctgagtttcaatctcagctcccccacttcctgggagtggaacctttggtcaagtcacttcacttctctaagcctcagttttctcatgtgtaaaagggcaataatagaatcacaatcctaaggcctgtagtttatagtattgtatcaatgttgattatctgtttttgataattgtaccaaagttatgtaagtttctgtaacattaagggagctggacaaaagtatatgtgaacgatttgtcctatttttgcaacttctctaagtctaaaattatgtcaaatttgtatctatttacttattgcaattaattttaaatgatttaagatttttagactcacaacccttaagagatattaccaggacaatagttgagttcttgggacactgcaggtgctcaatgaatgaatagtaaccattgtggctagtacatgctgctgatgctgccttcagaagcattctagaaaaatcctcaaagaggtaccttcttcaccgaggaccccaacaaaatcccaaatgaacagagcagggaggaaaggatacaatggtatcagattaggtgaagggaaagataggtgctcacggggcatctcctgaggtgcgagctgtctggtctgtttccctgttcgggcagttaggtggtgtgccaggtcatgggtaggattagccattgcaccagttgggacagcacagccctcactcccagccactggtccctctcaggctgcatcttggcaagagatgatcctgccagttgctttgaacatttatagtcaacagactcttgtttgccttttctttcttaatataagcagtctgtcatgcagctcttaggaactgaaggaatatgcgctctgtaaccaagatgctttacttttaaaaactcaattgcggattcagggctcttaaactagcaacagaccagctcagtctagacttgtgcctcccaatctagaaataactccatagaccaaaaagcagtaaaagcctcccaagcagtagtttttttttttttttttttttttttttttttttttttttttttttttttaaatccggggtctgtcagcacagacactggatagaaaagggtaccaggtcttgcagtgtttgaaaagctcagtgttaaggcattccttgccctctttcattcagcagctgctagctgagtgagcacactctgagaagaggggagagaccactctcacctcccctgcccccaccagcccctctccagggtgcctcctcatagatggtgggctcctcaaggacaaggcccaatccttagccccttctcccagttttgggctcagatttggacacaggaaatgttggtgaaatggtggagcaatccaatggtggatggtggagcaagtaagtgagccaggggctgggggctgagggaatgttgggccctgaccaccagagaagccaaattcaggagttctttccagagccccctttcatttattgcattaataagagaggattcgggagtgaaatgagacagatttctgtgcatgacatgactaatgcagggctttttactgttgatcacaaaaatagcccaaacatgtggagcccccgccccccaccgccaaccccagacatggatgacatcatgctggcctctgttgctttttggggggaagtcacactgttatcagctgttttgaccgtgcagaggaaagggtccttggtgaatgcagcaacctatgtctccaaaggtctcagctcatcagcttgagccctgtctgcctgcctcttcctgcctgccctcatcccagaggctgcaggctccactagcagacagagcactgggcaccctgccagttttccccagtcctgggtggggcctctgagggcagtaggatggcctctgattcataggagccatgccatggctatcccggtgaagacagggagccccatccatctactcttagggcagaagggaagaggcactccttggggttcctctgagcagcctggtgctcaggtgcctttccataatgtatctcctagctaccctgcatgctgctgcaaagaagaggcaggtggagaagggggaagatgggcaagtgaggactatctcagacagcctcaccaaatgctagctccagtgcaaaatcaatagtcacatggtgggatctctgctttaaaagacacttgattgtgataaaggatgtaaggctgctgttttcccctcttaccaaagggcttaaaatgcacatgctctgcaacttccaatagacctggcaaggttgaacatactttcccagataaatcaatcgaaggcagccatctcccagggcgaaagggaggtaccagactaaacaatctttatggggaggacaggaagtgagcttgcttcactggagctgatggcaggatgcacagaaggaccagggagcttgtccctgaggtgaagacctgcccctactgtggcagctttctggtgacaaagggacagctttgtcccagatgctagacaatatcgtgctgaacaataccatcccatactttctttccagcatggtttccatgctcaattcctgccctcctgagctgcagccttgtgtcaccaaggataaagcagggacaaagcttcaggagaaaatgcctatagcaagactcctgcccatctgtagactgtatgggactcacaagggggtaaagagcacagactcagagccatgtggcctgatttccagactcagcctagtgctgacaggctgggtaccctggacagccatgctgctttttctgggccacctctttgtctctgtcaagcagagatgcagcctctgctcagcccaccccatggttgcccccagaaaagctgttgttcagagttctcctaggttttcactggccagtgttctagcacggcagacctggaagggccttcagagatcatcttctccaatagtcccattttataaaggaggaaactgaggcctagagaaggaaggggctgatctgaggtgccaccagcctggaaactactttctttcacctctctttatgtttaaacttttacattgagataatggattcacatgcagttgtaagaaataatacagtgagatgccttataccctttacctccaatgggacacaccctatttttgaaaatgaggccaagatggggatggagtatgtatgtgtgataggataggtgaggagagaactagggtaatagaaatggctattgctcattcaaagccaggtctgatatgctttatcacaagctgaaactgcagaaagactctctgtacctttttgctgtattcaaggctattaagaaagtggattctgagtggcgcattttgcccatttatccatttggtttctcctaggacttttcctatacttaccctactccctgcccccacttcctttcatttgaagaataggaggccccataaatggaaggtgttggaaggcttggtatctgctctgcattggaaacctctcagcagtccctgagcaggcaggctggctttccgaggaaccaccactttccttctatgctcctttcctctctcaaagctccatagaccagatgacagcccttccactgcccatgatttataaaaaaggcaaaaagaccagctctcaattggcaggcctcgatggtcaagctggatctttatttcttcacaaattcttaaataccagcaaatggctagaattcatcctgacagacaacatcacttaagaagcatttctggcttaaaaaattagcttcagtcctcttttccttgggctggacatggggaatccttttatagcctctcaagtatcaattgtatttcgatttggttctcagccatgggcagttcactccacctaacttttgtataaccactgtcagaagcggtatccaaaaagaggctccaattactctcttagtttgtgtaaatgctcctctagtaaagctttttacttttcagctgcagtgaaagttgaagataaactccacagtaagacaagataggcaagaaaattggaccactcgagaagaccatgcatgggtggggacgggggtgggtattgccacattcacacacatatggcacttgagagagaagaatgacctgcgcaggatcaggaggtgtgggaaggatgcagaagcatatttatagcaggagttcaagccacatccattcctcctggcctgaacagtctaagtgctctctgatgaaactttttctgatgatgaaaatgtttcagatctgtgttggccaatatagtaggcattagccgtgtgtacctatggagcgcttgaaatgtgatggttagtgcaaccgaagaattggatttttaattgtacttaattttaatttatgtaaaaatagccagaggtagctagtagccactagctaccatagtgggagtttgcaggtctatacaatcccagaacaaacctcttggaatttgccaacctctaccatgcaccccatgacatctcagatcctgcaatggaaacttcctttttgaaatgttgctgggttgctttttcttgctaaaaacttggtcaaaccctaagcacagttccattttcataggctgagcaaaaggcacagcctagccttgccaggcatctctttttgggtgcttgggagcccaatgagtggggtgcatacttgtgactgaccggcagcctgcagcaggcacttggggcccagccccaggacctgaaggcatggcattgctctcagattcagtctttggtgaccttcagctgcaatccctatggcttctcccagtatggctggggaagccttgctcattgcctgggaggaggatatgtgcgtggaatcaagggcaggaaagagaagaggggtgacaggctttaggcctcttgtaacccagccctgggtcccaaggaggaggcaaagaactctaattcccttgggaagagctgaatggagagatcagatgatagggtcacagggaaggcccccagatctctaaaattcaagcaactcctgcaggatgtactgagtgcctgcttgtgacacacaggaggtgtgaagtggctacccacggagcccagtgtctgcagcctagaccactggcatggtctagcaaatacctctgctcccactcaggaagaggaggcaggtgaccaagatagggcctgcctgtttccaccccttcccagagcccaggccagctgaggtagacccgactcccacctgcctaactttggcctgaatcacgcaaagcctgggctgggtgctagagcgtgagtatgggaacaagagagaggccaggaatgctggtgtccagggaatttgagcccagtgtggtagggggagaaggaaaagggacagttgttccaaaaggaggtttggaggtgagccctaagaaacagaaatgagaccaagtagaagaaagaagggatcgagagtcagacagatctaagtacagatacccagatctgccacgtattggctgtaggtgtgcagttaacatttctgtgtctcagtttcctcacctgtgaaatggaataatactgtccctatattataggactgacatcaggaaatggctaaatgaaaagttatgtaaaaagcatctagtccatattttgatatattatagggccttaatacaaactagagtttcactgtaaaagaaaggtacgctgccccaggtagccatggggctgggaagaaaaggatagtctgggccagggcacggcagagagaagtagagaatgtcaccaaggagtctcaagtaggcaagggggagcagagtacatcctgagagcggaggctgggcacataggctgcacacagatcacagagggcctggaaaggtgcatctgactttggactatagcctctattccgtggggagccatggaatgatttgagcaagggagtaacagggtctgagttgtgctggaacaatacagacagtggaaaatcagaaagaggtttgaatggcttattctgccaggctgcttgggaagaagccctgggaattcacagccctacaaaactcccaaggaagagaagccaagtggagcttgcttttgtggcagtgtggtcagctgagaagggcgctggcacagccaagcaacccattggtggaaaagaagcaccagtgagctgcttgtccactcactgctcacacctactaagcaccgaaggaaactggcctgtagttctcacttctactgcagggtttcttgtttgaaattgatgactgagtagtctttgcaagcacccagtgtcaaaggggaccacagacatctggctcctgtacagatgttgggctgctaccctgggggcgaactgaatgctttctgtagccctattacctgtggtgtcttttcagagactctaccttttggggagacaactgtagggacccattcctcagaagcacaggcataggaagaggcagaggtggttccagacaaccgggactggcactagaggaagaacccagaggtaggcaggtactcaggggagcaaggaaaaagttcaagaattgggtcccaggcctggactctgcctcccttcctgccccatgtcccatctgaggctccctgttattgctgagcacccaaacctctggctgctaggtttccacttcctgactggcaggctgatggcctgccctagtgcctcatgactaggaccccgtctgacaacggtctaagtcccataagcaagtgacttaggatgggtttgagagccttggcaagtgtgcatgaagcagcccgtaggtggagctgaaaaggtctcagcttatgtggtggagagggctgggagccaggaagcctggcagtgcttgtggctctagaggatactgaggatgaactcaaaggcctttaacctcatttccttccaaaaaaaaaggccaacttttttagcaatgagcactcctcccagggactcccattggatagctaaagacaggcccttctggggaattttcttcccctgcacacttctgtctgggtgtagggactgtggaggccagcactggcctcataaaacaagcctgcaggagctggtatcctcaggaggcttgacatgaatgcccagatggcataagctcctattctttggtagcaacacatgcttttatgggctgggagagccaagacttttgataggttgctggggaatgggcctcacacaaatctagaatgttctagttggtgccaagctattttgtgactttgtctcgtgaccaaatcatgcagccaaaattacaaacagcatgccaacttttaacatgagtatcactttaccctggtaacaaatatgatcatttaaaaagtataataaataacacatttttgtatctggttttgcatatttcataagatacacacagactgagagcttgtcagagaggaagcagagctaagggatctgggggccaatctctacattctggggatggaaatggggaagctgagtcccagaaaaaatgaaaatacaggcaacatcatttatgcatttgtattgtaccttatatttgcaaaacatttcaccagcacttgaactttcacatgcactgtgggaggcaggatgtacagtgggtaagaacaggtaatcaggaacctggagctggaaactgacttctgtgagttgggccaagtctcttaatttccctgagcaccagtttccacctctgcaaaatgggttgttgtgcaagttcagtgaaataatacatagaacatgtttaatgtcatgactgacatacagcatggtctatgaaagtattggatataatttttaaaaatcttattaggacccataagtgcttcctaaagtgggaagagcaagattattagctcatttgacagatcagaaaactgaggcttggggagattgtcttaattttatagaactagagagtggtagagccaggaatcagtcccagacctctacactctacgcctggggccctttctgccacactgaccacatcttgtgaagatccttcctgcttgctcacccacctcacttataaataagctcaaggaaacctctttctgtcaaccaaaattgcagtaagaaaaacataattatcataaatacttctctaaagatttgaggtggctcatagtaaaaacatagatgaaaaggagcagtggaactaaaccaataagacagagacagaaacactcagagaaaggtaagaggtcatttcactaagacctgggggtgagatcgctgggaccaaaatacacttggctctgagcttcttggaagccagagcacaggaacaatggggcccagattctgactaccatcattaatagggaagtttctggatcaagaactgaccagggacagcagcagaggatgggggcggtgctgcatcattgccaaaggaaagggaggcccatgtacacccaaatggtccactgcagagatgccacagtcatgtagacccaggcctgccctggagacttcacaggcagctgagtcacaccagtttcccagcaggaacactgtttggggcaagcatgtaacaggccaggtccagcagggctatagccaaggagctggaaagtgctccttcaggagacagttgggccacagcaccacagtggtggtggcgggggcgggggggtggctattggcatcagcagagaacagaatggaatcagttccagagaatgccaggagctccatcctcgtgcaggcagataagtgtgcaaggctataaggcttagcatttctctggcccctcacatgcctctgtcatcagctacctagaccctggatggagccaaagtttcattcatctgtgccagggctaggacacaagggataaaaaaatcctcaagagttgggagagtggagaagcctgatggcttggaaagcagaaacttgggtgtcctgtaaaaatagtgctccatcaatacaagctgttatgggttgaattgcatccccccttctaccaaattgatatgttgacatcctaaactccaatacctcaaaatatggctttatttggaaataggttcattgacgatgtaataagttaagatgaggtcatattggagtggtttggtccctaatccaatacgaccagtgttcttataagaaggagaaatttaaacatagagacacactggagagtatgtcatgtgaagatgagggcagagatcagggtgatgcttctaaacgacaaggaatgccaaggatggttgggaaaccaaaagatagaagagatacatggaccaagttattcctcacagccttcagaagaaatcaaccttaccaacaccttgatcttggactcctagccccagaagtgtgagatcatacatttctgttatttaagtcaccactcagttcgttgtatttgttacagcagccccagcatactaatacacacacacacacacacacacacacacacacacacacacacgcacccctataggtgcaaaatcccttttcaaggcctgcaacacaggggagatacattcctggagaaacagggcacaggaggggttgcgtgtgtataaaacattagctgagtctaaatcaaattcccatttatatttaatgctgatacagagatgcataataaaaacagccccctacctctgtacagtgtactatagactaaaaatcacctccacattcacaatattgcataagcccccatcaacatagagtggtgagtggtaccatcctgagtttgcatgatgctgtaaggtgaaatgctttgtctgaggctacaccactagaaggcaaggggaagtgtcatttcctttctgccaggccagtgtgtgaatattcctgtgctcaggtgggggtgcaggggtcgtgtgcacttgcttggagaggacagggctattgcttaagaaaaaagcaagtggatttcttagcaattctcccttagtgtcttcccagacagcatgatggcattctgcctgcttgagttgtgaccatttttgccaccttggctcattatgactgcatctttctttccactgactccaattgtattcccaacttaagtctgagacaatcctctctcccccgggcagcagttgacaggaatcaaagttctttcatgttctctatcccatttgcaactcgccaagtactaaggagggaagcagggcatggaatgttatccaatttgaccactgaggcaaagaaaggggagtgactttcctgtcagcactgaggtagttggggtcagtgttgggactcaaatttcagtcaagttcagtgttatttttataacaatggatcttgattattatgcacctactataagccaggaactgccctaggtgtgtgaagtacattctcatcgaacccttccatttcccatatgaggagataagagactgagataagagaggcaacctgcccaaagtcagaaagtacgtaagtggtgaagctaggatataattacaggtctggctgactctagcttggcttgacataatcacccaatgctgtctcctctgtgtcacctccagagataaagatgtgaacaagtggccaggctgacagtatgctcccagaccccagtggatgcttatgagggatggccccaaatgcccatcatctagattgtagtccagtaatccatccaggaagtcccctggctcagggcccagctcctgagggctatttagagacagtctcattcattccccctaactcctaaaacccaagggccagctctcttggagcctggtgagcagcagccactcatgaatactccagtgacaccttccctcttgctcagagctggcctggagcccaactggtataaaccaccatactgcccaatgcaggtgacaaatttttgcatgtgagtcatccttggaaacttttggggcttgacataagagggtccacagaagcagcagtcactggcctgggatgcctacctctgctcagaggggcctatagaaccagtgactgggggatgtgcagcggccccacctgctggagtgggtgatgcagctcacctgcctgtgacacaagagcttagcccttaaggatagttccagagaaagatagaaatcttcctagagagaaatcattttttctaagaattgtaagctctggagatttgcaagggaacaacacagatgctggggaagaaggcaggtgccaggctaaataaagaaatgtgagcacatacagacagaatacgatcctttgtttccacagggaggcacaaatgtatattaatgaggattctgaatgccaagaaatcaaataagaacataaacatcacagtaaacaccaaagccccagcgttggctgaaatcacttactatagaaggggcacaggacttctaactgtgtgtcctgctctgaagccttccaaagcttcacaaaagacaactgctccacttgtagggctgggacttgacactctcataaacaagagaagctcctgagtttagccattgatactggagaaaagccctaggaagccactgcatgtgctcaaaggcacaacagcaaggatatgggctgggatttgtgtggtaggcaaggagctctgtatgaagtctgtggcaaattggtttattggtcccaagaggtatataaaccttcagatgggtaggagatgcggtgagagaggcaactggagaaaaaacttaaaatggacaacttcttcccaagattcccacaccacaagatgagggatcttagtgcatggccttggaggacatgggtgtgagtgtttgcacccctctaatcctctgccagctctttcctgccagccatataggcatatatgggccagttgcaccaatgccacacaatcctgctttgggcttatggtggatatctatcctttttttgactgcccaccatcttcactcttcccaggtttgagaaagctgaaaaaaacaccagttactcactttcccagcttcttttttaagctacggcacagtacatggctgagtctcaggccattcagttttgggtcagtgctaatgatgaagagaagcagggtcagtagagaatatggcacagaatctcatgtcctgcagcatctataccaggggaatcagaggccagtgatagcaatgttggcgaacaagctacagggtctactgctcagtagtgtaacagagctgctcttatcagactaactcagtgatatgattttatctgtaaatctggtcatatggcaaccaaacctgattctcaagcctcccagcaattctatgacctacccagtacccttcctagaaaccctttttttctgctttaataattcagagttagtttctgttgcttacaactaggactctgagaggaccataaatccttgttgagattctggaatatatctttcccgattctctccacagcccagccatactttgagttcaacataagtcttctctctcctaagaagcacagactaagtattccatttattctaaaagcatttcctgagtatctgttgtgagccaggtactgtgctgcatgctgaggatgtagaaataaattggactctgtttctttacttaaatatttcccattatagtgataaatgaagaatgaaaaagaaatgtgatgagggctatactggaggctagatgaatccctggctcatggctgcctgaccatgatgggaaaatcaagatgaaaagttgaggctttcacttttgataatgggggattagctttcccactaaaaatagacacaaattccagtcaaaacattaaaatatattctctctagaatgtcaaagatctgaaaagataaggattatgggggcaagatagaaaagaacacataatcagaaaagtgagtgcaacatctgggacctccttggtcaaaggtaatagaaaataaaaattagaatcaaatggaaatttcacaacagaaaaatacaataaccaaaataataaactcactagataggtataataacataaaatatatagtaaaataaagaattagtaaactggaaaataggtctgaataaaacagccagaatatgcaaagataaactaacaagaaacatggaagagagagtaaggggcataaagaatataatatctaatcaatgtgtaattggcataggaggagaagagttaagtgagagagaaaacaggagcagaagaaatactttgagagccagtggttaaggactttttatagtggtaaaaggtatcaaaccacagagtcaagaggcctgcaaacctcaagaaggacgaattcagagaaaaccacactgagaggcacatcacagtaaaactgccgaaataaaagagaaaatatcaaaagcagttagaatgaaattacataatgtttgagatttactttgaaatgatgcaacagtagtggaagaaatttatggggttacagatgaaaaatatggtgaacttccacttccagaaataatagattaacaggtgccagagaatcccccccccacccccacagtaaacaacaagacaactgctttcaggcattagaaattagacactaggctttaggcaacagataacacaagtctggaatccctgagagcgagggatgaaaaccacaattgctccagttctctgcatggggaaaatttcccaagtgcagaaatgagctggaatccaagcagtgcatagtggtactactgaggttaagaggcagagatcagagtttggaaaagcaaaaaatggttagatctttgggatgtggtcctcgagatgggagaactacaaatgggaggaagcaccaaaagtccatgtcttagtttgctagggcttccataacaaactaccaaaacatgggtggcttcaacaaccgaaatttattctctcacagatctggagactaaaaattcaaaatcaggatgctgacagggttggttctttctgagagctgtgatgaaaggatctgttccaggcctctcttcttggcttatagttggccatctcctccttgtatcttttcacattgccttcccttgatgtgtatctttgtgccccaaactcttccagttacactggaccagggcccctcctaatgaccttagtttaatttgattaattctgtaaagatcctatcttcaaataagaaaacattttgaagtactgagggttaaaaattcaacacataaattttgggaaaatacaattcaacatataagcatccatgtggagtctcctgcaagtctatatctgagtcttggctttaatcagacaaagcaagatatcatctgtaatgtcaagtatacaataaaatattgctaaaaataaaaaaaacacaaaattgagacatagtcgattgaaatcaacactgagatggtccagatgttgattttagcaaagacttcaaagcaactatgaaaaatacattctaggaattagggcaaatatgttattgatgagtgaacagattgggaatctaagcagataaataaaaagtatcccctcaaaaccaagtgaaactctagaactgaaaagaacaataactgaaatgagtaattcactggatggaattaatagcaacttgagaaggcagaagatagactcagtaaccttgaagataagttaatagaatttatcaaatgtgaagaacagaaaaaaaaaaaaaaccttcaaaaactgaacaaaaccccagggccctgtgggacatcaaatagtgcattatgtatgcaattatatagtctcagaaggagaaaagagtgaagatgaggcagaagaatattgtgtgaaataatggctctgattttttttccaagtttgatgaaaactttgacttataaaaccaagaagcccaatgaatccaagcagaataaatgcaatgaaaacaatacctagccacataatagtcaaataactgaaaaccaaaaataacagaaaatcttgaaaaaagccagaagatacacattacatacacaggaataatgatacaaaaggtggctggcttctcatcagaaagcaagcaggcagacagtggaattagacatttttaaagtgctgccaaaacaaaaacaaataatcatcctgtcaacccagaattctatatccataaaaatagcctgcaagaacaaggatgaaataaagacatttttagataaacaaatgataagagaattcattgccagtagccttacactactaaaagggaaatggtaccacatttagaaacttagaacaggaggaagttaaaagaatgtaaatggtaaataagtaggtaataatgaaggaacttggttttctaaatattacttttcataattcccttaaaactgattaaaatgcaaaggatatgaacagacacttctcaaaagaagacatttatgcagccaagaaacatatgaaaaaaagttaatcaccactggtcattagagaaatgcaaatcaaaaccacaatgagataccatctcaggctaatgagaatggtgatcattaaaaagtcaggaaacaacagatgctggagaggatgtagagaaataggaacacttttacactgttggtgggagtgtaaattagttcaaccattgtggaagacagtgtggcaattcctcaaggatctagaactagaaataccttttgacccagcaatcccattactgggtatatacccaaaggattataaatcatgctactataaagacacatgcacacatatgtttattgcagcactattcacaatggcaaagacttggaaccaacccaaatgtccaacaatgatagactggataaagaaaatgtggcacatatacaccatggaataccatgcagccataaaaaaggatgagttcatatcctttgcagggacatagatgaagctggaaaccatcattctcagcaaactaacacaggaacagaaaaccaaacaccacatgttctcactcgtaagtgggagttaaacaatgagaacacatggacacagtgagggggacatcacacattggggcctgtcggggggttgggggctaggggagggatagcattaggagaaatacctaacgtagatgatgggttgataggtgcagcaaaccaccatggcaggtgtatacctatgtaacaaacctgcatgttctgcacatgtaccctagaacttatggtataaaataactgattacagaaaaataatatatggtttataaaataagatttgtaacatatatagacttaaagaatatgacaaaaatcacataaagcatacagtgtgactggtaaatggaattgtacttttgtaagatttataattttataaaaaatcttttataattctcactttatatgtggcacttctcactttattattgctatgtggtgtaataataaagtgagaaatgtcacatataaagtgagaattagaaagtgtgaagtagaaagtgcaaagtgtcaggtgtgaagtggtaaaatactgactctaaatagacattaataagctgaagatgcatattcttagccctaaacaaaccactaaaagtcataaacagtgatatatctaagaaataaaatactaaaaaaattattcaccaaaaagaagcaggtaaagagcaaatagagatgggaacaaagaacagataaaataagtcaaaaacaaatattgagatggtacacctaaatataatatcaatgcccatattaagtataaataaacacttcaattaaaagacagaaagtgtcagatcagattaaaagagaagattcaacagtatgctatctataatgtacactttaaatataaagacacaaactggaaataaaaggaaaaagaaataccatatgaacagtaatcataagaaagctggcatggctatttacatcagataaaatagacttcaagaaaagagtatggtgaaagataaataagaatatttcataaagacaaaaggattactacatcaggaatacacaacaattataaaggtatatgtacctaattacaggttttcgaaatacatgaagcaaaagattacagaaataatgaggaaagagacaaatccagactcatagttgaaaattttaacatctcttttctcaataactgatagagcaactaaaaaattagtaatgatatacagtttctaaatgatattatcaaacaacttaacccagttgacatttgtagaatactacaaccaacaatggcagaataaacatttttcaagtgtacatggaacagtctcaaaaatggaacatatgcagagacaaagaaaaaactatggatttcaaaagaaatcttacagaatatattctctatccatgatgaaaatgaatcagaaatcaataacaataaaatatctagaaataacccaagtatttggaaattaaacaatatgtttctaaataatctgaggtgaaagaagaaatcacaaaggaaattaaaaatatttttgcactgaattataatgaaaatacaacatatcacaatttgagggatgtggcaagaagtccttagaaggaaatttatagctttaactacttatattagaaaataaggaaagtcaaaatcagtggtctgagcatcaaccttaagtaatcagaaaaagaagaataagttaaactcaaagtaaactgtaggaaagaaataatagacagcagaaatggaagccagatatcgacaaacaaaacatgaatgaaagcattagtggtagacaaataatttagaaaaaaaatgaaaacaaaagtagtacattgaaaagatccataaaactggtaattctctagctagagtgatcaagaaacaaagaccacaaatttatgacattaggaatggaagaggggacaccactacagatcctacacatacacattaaaaggataataagggcatactatgaacagttttatggcaatacatttgatagcttaggtaaaatgtacacattctttgaaagataaaaatgaccaaatctgatttaaaaagcagataatctgaatagctacagctactaaggaaattgactttgtaaataataaccttcccacaaatgaaattccagggccagatgacttcattggtgaattccattacattttaaggaagaaataacactgatactaaggaaaataccttcaggaaaaaagaagagaggggaacacttccttctcaagctgtcaagcaatctctaagcagcagcacattggcagctgctaggttggcttgccaaaattccatagatttgtctgataaggagacaacaagcccaaatagattcaaatggtttattacttatacagacaacaaaagtgagatcaacatggtgtcaaatcctcctgtccctcacctgacaggacaacaatgaaccagagcggccagatgacagacagcatgggcaatgaattgctctgctactggggaaccaactctaaacttatgcacttacacagaagcctatagatgtaaactaagtaggggtgaggtggaaagtcttgtgctcaagtgaaactagaaagatgggtgagaaatcatgttttggaagtttcccataaaatagggaggttaatgagaaactgtctcatggaagcttctcactaggcttcttttatctctttgttccaggaagaatcataggttatgctaacaagactcgggtcaggctatagttaagccttacctacatgacctatgtgaacacatgaaaagttgtcagtggaacgtggcagagatgttttcctacatattttcactttattttataaagctaataatatcccgatagcaaaaccagaagaagccaacctaaaggaaaaaaattagactaatatccctcataaacataccaggaaaaatccttaaacaatacatgagcaaagtgaatcctgtaatacatgaaaaggataatacatcacgactgtgggctatttccaggaattcaaggttattttaacattcaaaagtcaatgtaattgaaatttgtggaatgcaactaaggtagtgcttagagaaaaagttatgatgttaaatgcttatattagaaaacaggcacatgaaaaaatgctcatcatcactggccatcagagaaatgcaaatcaaaaccacaatgagataccatctcatgccagttagaatggcgatcattaaaaagtcaggaaacaacaggtgctggagaggatgtggagaaataggaacacttttacactgttggtgggactgtaaactaattcaaccattgtggaagtcagtgtggtgattcctcagggatctagaactagaaataccatttgaccctgctatcccattactgggtatatacccaaaggattataaatcatgctgctataaagacacatgcacatgtatgtttattgcggcactattcacaatagcaaagactaggaaccaacccaaatgtccaacaatgatagactggattaagaaaatgtggcacatatacatcatggaataccatgcagccataaaaaaggatgagttcatgtcctttgtagggacttggatgaagctggaaaccatcattctcagcaaactatcgcaaggacaaaaaaccaaacaccgtatgttctcactcataggtgggaattgaacaatgagaacacatggacacaggaaggggaacatcacacacccgggcctgttgtggggtggggtgaggggggagggatagcatttggagatatacctaatgttaaatgatgagttactgggtgcagcacaccaacatggcacatgtatacatatgtaactaacctgcacgttgtgcacatgtaccctaaaacttaaagtgtaataaaaaataaaaagaaaaaaaaaacaaagaaaaaagggccgggcgtggtgtctcatgcctgtaatcccagcacttttggaggccgaggcggtagaatcacaaggttaagagattgagaccatcctggccaaaacggtgaaactccgtctctactaaaaatacaaaaattagctgggcatggtgccacgcgcctgtagtcccagctactcgggaggctgaggcaggagaatcgcttgaacctgggaggcagaggttgcagtgagccaagatgacgccactgcactccagcctggcgacagagcgagactccgtctcaaaaaaaagggttgtaaatcaatgatctaagcatctaccttaaaatctagaaaaacaagagcaaagtaaacctaaatcaagacttaccacaaagttacaataaatactgacagatagatacatacatcaatggaacagagtagagttatgcaataggcccatacaaatattgtcaattggcttttaacaaagttgcaaaggcaattcaatgaagaaagaatagtctcaacaaatggtgctggagcaattggatatccataagcaaaaacaaaacacaatttaaaaagtgcctcaacctaaccctcaaacctcatactgaagtttcagagattatctgaaaaagtgtatagacattggcataaatgtaaaactataaaaatgtttaaaggacaacaaaaaagaaaatcctcaccgctaagttaagcaaatagttcttagacatgacaccaaaagcatgagcataaaagaaaagaatggtaaactgaacattaagattttgaaaatttgctttgcaaaagacactatcaagagaataaaaagaaagctacagattgggagaaaatatttgcaaatcacatatctgataaaagatttgtatctataatatataagaactctcatccaacaaataactcaaatcttaagataaacttttaaaggtaactgtagattcacatgcagttgtaagaagttatacaaagaaatccagtgcactcttccccagtttccttcaatggtaccatcttataaagccatagcacaatatcacaaccaagatattgacattgatacagtcaagatacagaatacttccattaccacaagcataccacattttgcccttttatagccacatctatttaccttctccccaaccccctctttaaccctggtaactaccagtctgttcatttctataattttgtcatttaaagaactttgtataaatgaaatcatacatatcaaaagccaatcataaatgggatagacatttttcaattagattatctggagattcattcagtttattgtgtgaatcaacaatttcccttttattgctgagtagtatttcatgatatggatgtattgcagtttgtttaaccactcacctatcgaaggacacctggaccatttccaattttaggctattgcaaataaagttacattcatgtgcaggttttatgtggacgtaagttgtatgatagttgtatgtttactttcttaggaaactaccaaactatttttcagaatggctgtgccatttaacattctcactaaaaatgtatgagtgattcagtttcaccacatcctccccagccttgttgttgtcactgttttatgaatttttttttagccatcctggcagatttgcagcaatatctcaatgtgatttttatttgcattctcctgatggctaataatgttgaacgtccattctgcttcataaatagtgtcactgaatatgtctttttgtatagctattttagtggttgtcttaagtatgatattatatatacataattttatcacagtttactggtgtcagttcaccagtttgagtgaagtatagaaaacttactttcctttacatcacgtaacctcccctatttataatgtaattgtctaaagtatttcttccacatatatttagaatcacatcaaacagtgttataactgttgcttcaaccatcaatttggaaaactcaagagaaggaatgtctactatatgtatctatatttttgctctttccattgtgtcttcttccttgctaatgtccaagattccttcctttattatttcccctctgtttagagaacttcctttagccacccttttagggtaggcctgctgggctatatatatatatatatatataatttttaaaaaatttttcttctgtgaatgttttgattttcttttcattcttgaagaattttgctcattagggtattctgggttgttggttctttcagcacttgaaaaatatgcaacttccttctgacttacatgatttcttatgagaaatctgttgtcattctaattgtcatttctctctttctgctttcaatatgctttccttgtctacagttttcagaagtttatgtcttggcatggatttctttaggtttatactgcttggaatttgtgcatcttcttgtaggtttacgtcttttgcaaaatttggagggttttccgtcattatttcttcaggtaccttttcagcctaccctctttcttctctcctactggaactcctatgacacaaatactacattttttattattgtcccacaggtcttttacactctgctcatttgttttcagtctgttttctctcttttttttttctttttatttggcattttcttaatttattaaaacttgaagtaataaacattattggtttcttttatatttttattataaacttttagtcttaagggtataataaattctatagaattagtgtataatcaattctatagaattagtagggggaatgggtagcagatgaacaagagaaatattttacaatttttaaagatgtcagtataaaaaacccacttttctcagaaaaaagtatacttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcccgcctcattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagcttttagcatgaagggttgttgaattttgtcaaaggctttttctgcatctattgagataatcatgtgatttttgtctttggctctgtttatatgctggattacatttattgatttgcatatattaaaccagccttgcatcccagggatgaagcccacttgatcatggtgtataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctgatagaattcggctgtgaatccatctggtcctggactctttttggttggtaaactattgattattgccacaatttcagagcctgttattggtctattcagagattcaacttcttcctggtttagtcttgggagagtgtatgtgtcgaggaatttatccatttattctagattttctagtttatttgcgtagaggtgtttgtagtattctctgacggtagtttgtatttctgtgggatcggtggtgatatcccctttatcattttttattgtgtctatttgattcttctctctttttttctttattagtcttgctagcggtctatcaattttgttgatcctttcaaaaaaccagctcctggtttcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcttgctttctcttgtgggcatttagtgctataaatttccctctacacactgctttgaatgtgtcccagagattctggtatgttgtgtctttgttcttgctggtctcaaagaacatctttctttctgccttcatttcgttatgtatccagtagtcattcagaagcaggttgttcagtttccatgtagttgagcggttttgagtgagattcttaatgctgagttctagtttgattgcactgtggtctgagagatagtttgttataatctctgttcttttacatttgctgaggagagctttacttccaagtacaaaccactgctcaaggaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagcctgcatcgccaaggcaatcctaagtcaaaagaacaaagctggaggcatcacactacctgacttcaaactatactacaaggctacagtaaccaaaatagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactgactagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttgctgggactgtaaactagttcaaccattgtggaagtcagtgtggcgattcctcagggatctagaactagaaataccatttgatccagccatcccattgctgggtatatacccaaaggactgtaaatcatgctgctataaagacacatgcacacgtatgtttattgcggcactattcacaatagcaaagacttggaactaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgtggaggggtggggggaggggggagggatagcactgggagatatacctaatgctagatgacgagttagtgggtgcagcacaccagcatggcacatgtatacatatgtaactaacctgcacattgtgcacatgtaccctaaaacttaaagtataataaaaaaaataaaaaaataaaaaaaagtatacttcatcttaaagtgtatttctacaataagtgtaatgattatatatcttgattggccaagattggataatatctattgcaacttcaagtttactgattcctctgtcccttcattttcctgttcaatccatctattgagctctttattttggttattgtattttttgcctctaaaatatccacttggcttttcttgatattttctatttccatttatttgctaaaatgttatattttttcatttgttccaagtgtgtttcatttgttccaaatacgtttgaatatcattgaaatttctcattatttttacaatgggtacattagatttttgtcaaatccttcccatatccctgtcatcctggtgttgggcatcaactaattgttttttttttattccatttgaaatgttcattctttgatgagtgattttgtatggatatcttgacatttggggtattatgttacgagactttaggcctcatttatatcttctgtttaatataatttattatgacaccaatgcagcaagggaagagggaatgaagtgtcacctctttatagccatatggggacaaaagttcagattacttctgttggcacctgaggcaggatgatgctccttgttactgctgcatagaggtgggagatccagatccctagtaggctttcaatgatacttccctggatggaagaggtagttgttacctttttactgttcctcatgttgcctccactgacaccacatatgggtgcagtggcctcattgccaccataagatggtgaccctgaatctccagtaggcctcctctgacaccatttcagcaaggagtctatggaatgcctcattactgccttgtgaggacataaatccaggctccccaaatgatctccactggcatcacgggatgaggagatgccttgctgccgaatggagggaatgaaagtcctagctccctactcagccttctctgacactggagcctcattacagcctggcaaggatagaattctagctttcccactcagcttttgctggtgtgagtgtggtcaggccaaaagtgtttgtttgtttgtttgtttgtttgttttcccctgtggcattgggctaaaacagtatagtcattgcctaaaatacttctgtcttgataggctacccctagattggattgttctgtatcctgattttggtggtagttacaccaatctacccttatgctaaaattcatagaactatataaaaacggcagtttacaaataaaagtttttaaaaaagaagagcaaagttgtaggagttacattgactggcttaaataattgttataaagattaaacaactggggaagtagagtattggtataaggatagacaaatgtatcatgggaaaaaattagaaagtccagaaatagcctcacacatgtatgaccaattgattttcagcaaagatgtcaaagtgatttaatgggtgataacatagacttaaaaaaaaaaaggtgcaattacaactgaatattcatttggggaagatgaacctcaacccttattacataccatatacatatattaacttgagatggttcataaatctaaacataaaagttaaaactataaaaattcagaagaaaaaaataggaaaaataattgcaaatttggaagaggcaaaaatcttgataggacacaaaaagtataaactatataagaaaaaatgatacaatggatttcattaaattttgctctttgaatcactaaaaaaaatgaaatggtaaatttgcaaaccatagatctgagaaaggacttacatcaagaatatagaaatcacaattataatttaataacaagaccaggaacccaatttaaaaatgggcaaatgattaaaacagacacttcacaaaagaaaatatatgaatggccaacaagcacatgacaatatattcactgtcacttgttatcagggatatacaaatttattcccctctttccctgctgcattggtgttagaataaactatgttaaagtataaatgagacccagagtctcataacataatacctgaaatatccaggtttccatgccaaatcactcatcatatcaagaatcaaaatttcaaactgaacacgaagagatgccacttcatacccacaagaatggtaaaaactaaaaagctgtacaatatccagtgttgttaatgatgtggggcaaatagatctcagacgttgcattgtggaactgcaaaatggtataatcactttgaaaaatcctctggcaatttataataaagttgaacatataccaattatacagcctagcaattccattactaaatattagccaagagaaaagaaaatttacattcacagagagacttgtatagaaatgttcatagcagcttcatctgtaatagtaaaaatcttgaaacaacccaaatgcgtatcaataggtgaatggatgggtaaacaagttgtagtatcttcacaacatggaatattgcacaacatgggaaagaaacaaactactgatgcatacaacaacattaatgaggtcaaaaaattgtgatgaacaaaagaagccagggacaaaggagtacatactgtattattatattcatatgaaattctacgaaaggcaagacttacctatagtgacagaaagcagatcagtacttgcctaggacaggggtaggagaagtttgactgcaaaagggaaggagaaagctttttcaggtaatggaaaggttctatatcaataacatgtctcaatctcacaaacaatgaaaggaagtcatgcacaaaagaatatatactgtatgatctcacttatattaagttcaaaaatataggcaaagctatagtgtgtttaggtatccctagttaagtggtaaaactctgaagataagcaagtgattactggaaagtcaggctagtggcttcccggagtggggagcaggggtatagtgattaggaagggacatgtgggtggtatctggggtgctagcaatgttatgtttcttgatctggatgatggttacacgagcatttgctttatgcagtttgttaatctggctacatacctttttgtttctatgttatatttcacaactaaaaacattttttaaaaaagcaaaaacggcaacagaaaggcaagctgaggccgggaaagttaagatccatgcagacaagcagcaagtcttggtggactggaactgtgaagtatttacagggcaatcctttaaattggtgggagtgagggcatgccaggctggacagtgcatcttaactgctgccccattccatacctagcacagggatgggcctacggtacacccaacttaggcttgtggatacaccagtggtattagggtatgccattaaggcacgcccaaattagagaatattccctagtggctacctaccaaaaagcactggacttgaagacaggagaccaaagtttaggcagtagcaatatcacttcaagatacaagaccttgaacagaccatgttaactctcagcattagtttccttattactggccctggctatgaagagcaatgagagacagaatggagatagataattatagatatatgggtatacatacttagatatatccttctgtatccaagcccagcttttaagtatacaagctagcccagctagtgcagtaaagtgttaaaagggaaacaccaaaggcctcaagttaagacagtaccttggtcccctctatatcttggccatccttaggtttaattgcctctgggtgtgaatggtgtgaattagcatggtggtgtgaggggctgcatgcccactattccaagctgaatatccaaaaaggttacaattatgaagggggtagcaggaatggggaggggacaatatatgaaggccaaacactttgacgttacttcacacagtcccaaggtgtattttctcgtgcatcaggcttgcaggcaggggtcagggtgctcaaggctgacattcgacaggacaagcagagcatcagcaccaatggtggatgagtgaggtagtgtcatcactgctgtctctacaaactgctctgtcacataccctgctatctctgggacaaagggaaccttgtccagtagtggggactggggagctctgcctacagtgccttcaaaagaccaatgaacattcaagcttggaatttaggacaagcttccttctcccatttggggaagattgcctattttctatttatatgagaaaaagtttgtggatacacccctggtcactgataggcaagaaccatttgtaaattagagatttaagatgaggcctggctggcaatctaggaatgacaacaatggaccagatgctacaaccttatccatttcaagagcttcatgaatagccagttgtaccatggaaggatcctggcttcttatttatttattttccataagttatttgggtacaggtggtatttccttacatgagtaagttctttagtggtgatttgtgagattttggtgtggccatcacctgagcagtatacactgcaccgtatttgtagtcttaaccctcgaccccctccactctttcccccaagtccccaaagtccattgtatcattctcatgcctttggatcctcatagcttagctcccacatatcagtgagaacatacgatgtttggttttccattcctgagttacttcacttagaatagtctccaatatcatccatgtcactgcaaatgctgttaatccattcctttttatctcacagtttctttatccactcgctgattgatgggcatttgggttggttccacaattttacaactgtgaattgtgctgctataaacatgcgtgtggaagtatctttttcgaatagtgacttcttttcctctgggtagataccaagtagcgggattgatggatcaaatggtagttctacttttagttctttaaggaatctccacactgttttccatagtggctgtactagtttacattcccaccagcagtgtagaagtgcttcctgataaccatgcccatggaatctccttggcatccacgccaacatctactgttttttgatttttgtattacggccactcttgtaggagtaaggtggtattgcattgtggttttgacttcaatttccctaatcattcgtgatgttgagcattttttcatacgtttttttggccatttgtatatcttcttttgagaattgtctactcatgtctttagcccactttttgatggcatttgtttgtttgtttgtttttcttactgaattgtttgggttcgttgtagattctggatattagtcctttgatgtatagactgtgaagtttttctcccattctgtgggttgtctgtttactctgccaactgttccttttgccgtgcaaaagctctttaactaggtaccagctatttatctttgtttttattgcatttgcttttgggttcttggtcatgaaattcttgcctaagccaatgtctagaagggtttttccaatgttgtcttcaaaaatttttgtagtttcaggtcttaggtttaagtgcttaaaccatcttgagttgattttgtatatggtgagagatgaggatccagtttcattctcctacctgtggctagccagttatcccagcaccatttgttgaaaagggtgtcctttccccactgtatgtttttgtttcctttgtgaaagatcagttggctctaagtatttgggtttatttctgggttctctattctgtttcatgggtgtatgtgcctatttttataccagtatcacgctgttttggtgactatggccttatagtttgaaatcaggtagtgtgatgcctccagatttgttttgtttgtttgtttgtttagtcttgctttggctatgcaggctattttttggttccatatgaattttagaattttttttataattctgtgaagaatgatggtggtattttgatgggaattgcattgaatttgtagattccttttggcggtatggtcattttcacaatattgattctacccatccatgagcatgggatgtgtttccatttgtttgtgtcatctatgatttctttcagcagtgttttgtagttttccttgtagaggtcttttgactccttggttaggtatattcctaagtattttatttatttatttatttatttatttatttatttatttatttttgcagctattgtaaaagaggttgagttcttgatttgattctctgcttggtcactgttggtgtatagaagagctactgatttgtgtacattaatcttgtatccagaaactttgctgaattcttttatcagttctaggagctttctggaggggtctttagggttttcaaggtaaacgatcatatcatcagcaaacagtgaaagtatgacttccttttactgattcgaatgccctttatttctttctcttgtctgattgctctggctaaaacttccagtactatgttggagaggagtggtgagagtgggcatccttgtcttgttccagttctcagaagaaatgctttcaacttttccccattcagtattatgttggctgtggattgtcatagatggcttttattacattcaggtatgtcccttgtatgccaattttgctgaaagttttaatcatagagcgatgctggattttgtcaaatgctttttctgcatctattgtgataatcatgtgatttttgtttttaattctgtttatgtgatgtatcatatttattgacttgcatatgttaaacaatccctgcatccctggtatgaaactcacttaatcatggtgggttatctttttgatatgttgttggatttgattagctagtattttgttaaggattttagcatctatgttcatcaaggatattggtctgtagttttcatttttggttatgtccttccctggctttggtattagggtgacactggcttcatagaatgaattaggaagggttccttctttctctttcttgtggaatagtgtcaaaaggattggtaccaattcttctttgaatgtctcatagaattctgctgtgaatatgtctggtcctggactttttttttttttttgtcggtaatttttaaattaccatttcaatctcgctgcttgctattggtctgttcagggtatctaattcttcccgatttaagccaggagggttgtatttttccaggaatttatccatctcttctaggttttctagtttatgtgtgtaaaggcgttcatagtagccttgaatgatcttttgtatttcagtgctgtcagctgtaatatctcctgtttcatttcttagtgagattatttggattttctctcttcttttcttgtttaatcttgctaatggtctatcaattttatcttttcaaagaaccaggtttttgtttaatttatcttttgtatttttttgtctcaatttcctttagttctgctctgatcttggttatttcctttcttctgctgggtttaggtttggtttgttcttgtttctctagttccttgaggtgtgaccttaggatgtcagtctgtgctctttcagtctttttgatgtaggtgtttagggctatgaacttttctcttagtactgtcttttctgtatctcagaggttttggtaggttgtgtcattactgtcattcagtttgaagaattttttaatttccatctggattttgtttttgactgaatggtcattcaggagcaagttatttaatttccatgtatttgcatggttttgaaggttcctttttgagttgatttttagttttattccactgtggtctgagggagtgcctgatataatttcaattttcttaaatttattgaggctcattttatggcctatcacatggtctatcttagagaaagttccatgcactgttgaatagaatgtgtattctgtggttgttggattaaatgttctgtatatacctgttaagtccatttgttccaaggtatagtttaattccatggtttctttgttgaccttctatcttgataacctgtctagtgctgtcagtggagtactgaagtcccccactgttattgtgttgctgtctatctcatttcttaggtctattagtaattgttttgtaaatttgggagctccagtgttaggtgcatatacttttaggattgtgatattttcctcttggacaaggccttttaccattatataatgtccctctttgtgttttttaactgctgttgctttaaagtttgttttgtctgatataagaatagctacctctgctcacttttggtgtccatttgcatgaagtgcctttttccacctctgtactttaagtttatgtgtgtccttatgtgttaggtgagtctcctgaaggcagcagatagttggttggtgagttcttatccattctgcagttctgtatcttttaagtggagcatttaggttatttagggtatttacattcaatgttagtattgaaatgtgaggtaccgttgcatacattgtgctctttgttgccagtggaatttttttttttttgcttttttaacttgtatttttgttttataggtcttgtgtgattcatgctttaaagaggttccgttttgatgtgtttccaggatttgtttcaagatttagagctccttttagcagttcttgcagtggtggcttggtaacagtgaattctctcatttgtttgtctgaaaaagactgtatctttccttcatatatgatgcttagtttcactggatacaaaattctgggctgataactgttttgcttgaggaggctgaagatagggccccaatcccttctagcttgcagggtttctgctgagaaatctgctgctaatctgataggttttcctccataggttacctggtgcttctgtctcacagctcctaagattctttcctttgtcttaactttggataacctgatgacaatgtgcctaggtgatgatctttttgtgatgaatttcacgggtgttctttgtgcttcttgtatttggatgtctatgtctctagcaaggctggggaagttttcctcaattattcccccaaatatgttttccaagcttttagaattgtcttcttcctcaggaataccgattattcttaggtttggtcgtttaacataatcccagacttcttggaggctttgttcatattttcttattctgttttctttgtctttgttggattgggttaatttgaagaccttgtcttcaagctctgaatttctttcttccacttgttcaattctattgctgagactttccagagcatttcacatttctaaaagtgtgcccaaagtttcctgaattttttattgtttttttctttaagctacctatttccttgaatatttctcccttcacttcttgtatcattttttggatttcctgcttcgcctttctctggtgcctccctgattaccttaataactaacctcctgaattctttttcaggtaaatcagggatttcttcttgatttgaatccattgctggtgaactagcatgatttttggggggtgttaaagagccttgttttgtcatattaccagggttggttttctggttccttctcatttgggtaggctctgtcagaagggaaggtctagggctgaaggctgttgttcagattctttttgtcccatggggtattcccttgttgtagtactctcccccgtttcctatgggtgtggcttcctgtgagccaaactgctgtgattgttgtctctcttctgggtctagccacccagtgaatctacccaactccaggctggtactgggggtcatctgcacagagtcctgtgatgtgaactgcctatgggtctctcagccatggataccagcacctgttcaagtggaggtggtggtggtgtgggggtgcaatagctccatgaaggttcttagctttggtggtttaatgttctatttttgtgctggttggcctcctgctgggaggtggcactttccagagagcatcagctgtgctagtatggagaggaaatggtgctgggcagggccctagaactcccaagattacatgcccctttgtcttcagctaccagtgtgggtagggaaggaccatcaggtgggggcagggctaggcgtatctgagcccagactctccttgggtgggtcttgctgtggctgctgtgggggatgggggtgagattcccaggtcactggagttgtgtacctaggaggattatggctgcctctgccgagtcatgcaggttgtcagggaagtggaggaaagccggcagttacaggccccaccaagctcccacacaaaccgaagggccagtctcactcctaccgtgcaccccccaacagccctgagtctgtttccaggcggtgagtgagatgggcttgaaaacatgccccaggctacccacctcccagctgcaaaataaaagggattgattcttcccctgcctgtggagtctgcacactggatttgcaccctcccctgagttctggccaggaggcttcttgccccattcaaattgttatgaagttcagctggagatttccttctgtctgtggagttttaccccatgctcctctggccaccctcccaatgaatccctgtggtgccaggtaggaatgggctgtctggggacccagcgagctcccagggcctttctgctgcttcctctacccctgtatttggcttggctctccaaacttggactcagctccaggtaaggtaggaaacttctcccacaaacagaccttcagtttctccagtgggggtgtgtgttcgggagaggagggtctccctttcccacttttgcagttgggacactcacagtatttggggtgtttcctgggtcctgcaggagcatctgcttccttcagagggtctgtgggtcctcttgagattgctggtttgttcttgcagtcaatctgaatcttaaatttacaagccactgcacgctgctctgtctggagctgcaatctagtcctgcctcccgtccaccatgataatccctccccaactggcttcttttcaataatatgtcatggtgctgatcatgcatcaaatggcaccagcacctgttttcctgtctgtgttcctcatatatacacttttattattaagtagatgtaagaatccatttaaaatagatttagctttggggagaaattctgtgttgattctgcccacacaaaggtgcatgtacccacacaaacagttccttctagaaatgcaaaaacaatatagcaatgatactaatgatcaagatattttataaaggaaatcacccaaatcccatcaccctaacacagcttttttcatttacgcatttactatgagtttttgtaagttgcaagatcacagtgtaaatacaatggagcctcttccttttcaaaacctgttccatgtattcctcagactgctgcaggtttcagaatgagcatattaaatgttctgataatatgccatggaatggatatgccataatttaattagccacccattattgttgggcaattcatttgttcccagtgttatattactacagccaatttcataatgaacatcttcatgcatgtatcttctcaattctgttgaactgcttcctgaggaataaaatctcaggaagaagaattattgagttaaaggtcaggaacagttctagggctcttgcttcagttgactgggctgccttccacaggtgtgggtccctttctaaaatgtgcataccctcagcactagccagctttcccctttagccccccaaacctgtcccactcactcttgatgtcttagttactgcctgttgtgtggggatcaacttctatttgctctctgcgtgctctgcaccatggtttcaaaacaatgtaaacctgttttgggaaacacactcagctgaagtggaatagcctctcagctccaacagctgagagtccacagtaattatctttgggggatgccaggcttgggaagtaaggagcagatgcgtttgtttctccaagcccacactgcagagaactttcccctacactcttgacaagtgaaccacaatgctctgacacagtcagccttatactgactaccagctcccctcaacacccactatgtggcaggccctactacaaatcagatatggctcttgccctcaaagagcccacaaactctggtaaagacaaacaaataaagaactaagagatgcaatgtggtgtcacgagcaagtgcattgtaactagtctgacctggattgggacttcagccttgccatcttcttgctgtatggacttcagcaagtttatatatatttatatatatatatatatttggtcttggtttcattctctacaaattaggaataatggaataatattaataccagcttccctccagttgttatgatacagtaaacagaaccctagtattcttgcctgggggatcaggaaatgattttctgtcccccacccccaccccagggagaatgtgctggaaagctccaaatggcatgaggattgggtctctctcaccagtcccaggacaggaaggcctattggtgaaccgcagtgagcagccctgaagtggctggagagtacaggacctcagtgacttggggctgcctgcaaaaccattcgcaaaagttccactgtctctgcctacattatttctaccaggaggggaaagtaacgtggctcagctgactattctttcccaagtgctaaactggcttccttgattagaaaaacacagccttaggccgatggccttgccagcaatcagtgctaatgcaagacccagctgaggaatacagcggaccaggctccatgcccagtgccacgaagcttctgccttgtccaggacatggtccagagatagaaaatgctgattttctagcagagctactaagagtcaacatttacaagtgccagcgatggctttcatgcaacgaaaggcacaagagtggggcagctctcttcttgtcacaccccagagtccctgggtaaactttcccagaggaactgtcaaatgataatggccatgaatggacatgtccagcagtacagacagccacatgggtcacagaagtacccatcactactgtagttagcacactctgcccatcaagatttgtactcatttctttctgggaacaatctgctctcttaccatggctaggaatctactgtccacatctaaaataggcgcactttccattcaatttatccatttcttattacaccccctgttcaataaccattgtctgagtatctactgtggtagatgtaaacctgagtcagacaccatcctcttgcctcaaataataacttaagcagaatcaccactggtcacagcaatgcagtcctgggtaatgatccactccagcatttcccaaagtatgttccacaaacattggttcctcaagattctaatagatgctcagctccaaaaggattctgtggtgacaaaagtttaaggaaacttgagtggaggaaagttagcaagccttcttgattgccaggcttgccagagcctgtgacatgtcaaggtgctctgtcactctccaataggagctagagaatgcattctccaaacacattttactccagacccatgtggaaaaagcatttcatatggccagcagtccagacaacacattttgggaaatacagaactcttccaatccccttattttttagataaggagattgaagcccagagaaggaaagggatttgcctgagctcacccaagaggtctgaggcagggtcacactaattcagctgtagcacattcagaagggatgtctctaatctgtttttcacattgggaagccattagagggttttcagcagtggggatgatgcaattgaattagcattttaggtaaatcgcttcagctgatgtgtagaggagactctagagggatgacagtgaggggacaatgaagagtaatccaggtgacagataataaagacctaaatttgtgcagtagcaggagggtaggtgaggtaaagatacattccagaaataattaggaggtaaactggcagaacctgatggcagattaggtgggtgagtggaaggagttaagggtgatgctgagaaatctggcctgggtgactgggtagatgccagtgccatgcagtggagaagctgtttggatggagtttttaagtaggttgaagacttccatttcagtggctgtggaatgatcagtgtagatatccaagtagcatttggctttatggggggaaggttttggtaagagaccaagatcagggagataactgcatattgatgaaagttaaagcacaagaatgagagaaatagtccagggagaacctgtagaggaagtagaagcaatagaccaaggctcagaaacttggagaactcagttctggcctccaaagagctcgccatctaaaaccttaatcttcctccagagttcccttcaaagcacctcctccaggaaaggaatgctgccctaagagatatatgaggtgttgggtcaatttggaggacagagaattcatatgtgatggcataattaaatgtcttctgttagcacaccagattctttttttttcactgcttcaatggtcgttttttattaaaattcaaaatacatgataagaaattagacttttatcaatacacaaataattttacttaaaatcaacccagttacatatttttaaaaaattgcagaacctctgcacaccaatgtccacaacctagaataggttcatgtgaaacctgcagttctaccccggagcatcaataagtgatggtccaggtactcactgacatgtttctcttgacaccgagagggtcgcaaacaaaacaccactcttgcctggatgaagcaagagttacataaaagagctttataaaatgactatgaaggagaattggtaatatcagaagagctccagcacttcaattgaatataatcctctgttattcttttcttgatttaatttctgtagctcccaaaaacttacttcaatcttgttgagcttggaataaacagatatctgagattttacaagcttgtaaagatttatcagtggcctctttgcttctggcatcattgctacaacagtaaaatttgcatccagaagtagacatatccaatccataatctggttcaaggtaggtgggtgtattccaggaagagtcatagtagcattttcgctacacttcagataaaggaaacacaaacacttgagaaacagtgtgatatgctgtgctgggatgtttttcaaatgaggcagaagaaatgtttcgctatatgctgaatgaagaattgcattaagtagagctgctctttttggtatcacagagcatgaaatggtctcctttgtcttgtcctggggctttttatttaactcttgatcacagttactgtatttatcttcttcaggattgaagccattttgaagaattccagtttgctcttccattttctcatcatgtacagaattactatagtcaaaaactgactccatactgacatctgtttcttgaatactgtcatcaccaattctcaagaaaatttgtaagcaagcacaggtgaccgattcaggaatgtcagggaactgctgtagacagagttgtaacaactgtacatctttcttttttaaggcaatctccattaagtcagggcacaaactgtaagaaagcacatgcatttggataaggtgcatcagacagttccggggataaaatgatggttctgctttacacctttccagaagtcctgttactgtgtccccagtgacagtatgaaagtcaggggtctgcttcagagccaaaaatttccatacttctacttcagtatgtttctctgaatctttcattatggttgacaaaagttgtttggatggtgatacctctggctgtaaactcacttcaatttttcgtctccttaaaattcttcttgactgctctgagttctgggacccaagtccacatccttgaggtgtttcccagtttacaaaatggggcacgacatgagttcctggatcttgactatgcttgagttttccatgagcacctgctaatgatgacacttcacagttgtatggaatcacagagattttccacgtagcataaacacattttccccataataccagagttgaccactggtcccttgtggtaactcttttgaagtctgtagtgtttgaaattttatgttccatacagagaggcattccttagaagctgctagtggacttcctaggactgtgacgtgatcctgatccagcgcagtgagtgcaactccatttcaagtgttaccagacacaacagccttgagcaacagtgatctaactaagctctgatttttttctgggtcagttggacgtattggcatcaaggtttcatatatacaaccatcagagcttaatgacgtcaaagagatgaatttctgatctaccaatgcagtaaaactctctataaaatagtttttgtcttgtccaactaagagtgtatatttggttaagatacgtgagttaaacatttgcacataagcaaagtgatttccatgtttttcagtaataaaaattaaaacaggatgtctgaatactatgaaaaactttgtccatttaatcacttcatcagagataacagcttcaattttctgctgggggcctgcaagcgaggcctctaaaccacgaacaccttccttgaagagcaccaagggttctgacccttgcactgaaagtttcctatatacttcaactgacaatgtagctttaaatactttatccaggtttacatcttcattattccagattcttaaaatcttattattgtgtacaacaatatactctccagtttgaaagttgcacacagctggacatgttacaatttgaccctgtttcactgaccagctccccaagggtttctgatcagaaaccttatagaggatcacggttctgccactgtctgtcactagaaactggtctgttttgtcactctgcttcatgcctaggagtccttcaggccccgcgctcaggactactgaagacaacgtgaattcttcctccagcactgccattttgagcaaacttagcacactggattctgaagaggtgctgagaaagcttgtaggaagatgcagttttcctcagatggatgtgtgtgtttgtccctttcaccttggagtctagttatgtgtacatgtcttatcccctcagtaggcagcgcacttgctcctgaagagaaaggagtcctaaattctcagaagtccccatggaacccgcagagtacctggcgtgtagtactcaatacagatttgctgaacacatgaatgagggtgaagatggggaagggtctctggccaaagaaatagtatgagcaatgtcccacaagtagggaactacaggaaatgcagaatgattgagtgtggcccatgcatagactacatgagtgatggagaaagaggaaacatagaagactggcaagatggactgggaccaggtgttgtggccttgaacaccaaactgtaggatctgattaccttcaagtgctacagaaagctggacaggtgctgtaactgtggtgggtccgagcagaggtgagcttcccctcagaggctcttttttgcttcccctacctcctgtcagggaagcagtgatgagggctctgtcagctcctccctgctttctcttgctggatgctgcctgcagtgtccaaaaaagtcaccataagcaaagtcactgtcatttgcgggagccaaccgcccattccatttcattgcttctgtatccaagaggaaaagaggtaggtctaaagcctgagataccatggaccctcaggaaagctatgagaagggagtccacagccctgcctcattagttcatatacaaaggtgtaagtttttcacttcacttcctcctgtggcttctgaatgctggggttcaagtcagatattctcagcattcattgccctggagatggtctttttaatatcccaggcatctgtgaccttccactactgcatgtccaaattctctccagtctgaaaaatttagtgacaatgtttcctcttacaggaagcctgtcttgcagagcccttcagctcaaagtgactgtttcctcagaatgtctgtattactgcagctgcagtcctcaaccttattgcctggatacacattttatatcctgcccttttcccacacaaaaatagttaaggtccatagtaaggggtatgattgaattatctggagacaggatgttcgagtggacagaccatgcacactacaatcaggcaaacctagatatcaacaccagctctaccacttcctggcttcattaccttagacaagttccttaactgtctcagagactcagttttctcatctgtacatggcagaatataataggatgctggcacagttgctgcaattattagctgagaaaaaagcaaagcatcagtaataatacctggcaggtttttggcactcaaaaataattccttcctctcctttgccttcaatattcttcacagggcctagcatacagttttcattcattgatccagccaattattaattaaaacattactggggaaagatagtatgtacattgacataaaaattaaatacttaggaataaatctaccgaagagatctattcaaatggaaagatttacaatgttcacgaataggaagagtcactattataaagatgtcagtagtttccacactgatttattaattcaatgacatatcctgagagttgtgtgtgtatgtgtgcaacttaacaagctgcttctaaaatatatatgtgaaaagtcaagtatagctaaagtattcttgaaggaagaaaaaggggggaaacttgctctactagatatcaagatttattataaagctatagtaattaagacagtgtggtattgtctcagggacagacaaatagaacaaggaaacagaatgtaaagtccagaaacagatgtatacatacattgagacttgatgtatgacaaaggaaatatttaagtatggattttagttaataacaatgtattaatatattagtttattgattgtgagaaatataccatacttatgtaagatgataataataggtaaaactggattcagcgtttattataactccttgtactatctttacaacttttccctaaatctaaacctattctaaaatacttttaaaaaaattattttaaaacaagtaaaaaatcaattccaacaggactaaagaaaactaaatgtataaggcaaattgtaagaaagattatataagagaatgtatgaataatttgggggtaggaaacacttccctgcataagattttaagaaaagaatcacaaatgaaaaatagacttgaccacatttaaattaagaatttttattaataaaataatatgactaagaaggggaaaaaaacaagctacagattctacttccagcaatagacaagtaagctcctattgaccctatctcactacagattaaaactatgaactctggagaaaaacaaaacaaaatataaatacactacttgaaggcagtgtggagggatcaaaagcaggcagatagtggaggggggtcaacacttggaagaagaaaatggcactgggtcagtttcccattacttttctggtgtttagcttgaggacaggacccagactgtaccatgcagagcaacttaaactgtagtggaaaagctgtagtctttctgtattgaagaactagagtacagagttcatagcaaacacaactactgcgaagtaaggaggaaatcctccaaaatgagaaagccagaaagaaagagcatcaaatcctatgtataaactacatccaactctctgctgaccccaaaccatgcatgtgtgtgacagactctaaggagaacagctaagactaaaaaaactgaaatgttatttgagctgttatccattgtagaggagaaataacttgcagtttgagtccagccagtctagttgccagctaacacaaacaaaacaaaacaaaacataagtaaaatcaatataacaaaacaaaaatcaacactcttccaaggaaaagagcaaaaccagggtcccaacacatatgaagaaccagaaaagcatgaggaaaactcaagagaaaaggcaatcaactaaaagtagccctaagatgattcaaatgttggaattagcagacaaggattttaaaagcagctattatagatatgctgaagggcataaaggaaaatatgcttataatgaatgaaaagtcagaaaatatcagaaaagaaatgtaaaaattataataaagaactaagtggaaattctagagctgaaacatataatatctgaattaaaaattcactggataggcttaacaacaaactagaaatgacagaagagtcagaaaacatgaagatcaatagaaattatccattctgaagaacaaagaagaaaaaataacagaggctcaggaacctatagaatattataaaaatatctaaaacaaatgtagttagtgtcatagaaggaaaagagagaaaataaaccagaaaaattgtatttgaaaaaaatgacagcagtaaactcccccaatttgatgaaagacataaaatcacagatttaaagacgttcagcgagtcccaagtaaaatgaatacaaagcaaatcacagctaggcacatcacagacaaactactaaaaaacaaagataatgtcttaaagaagctagaggaaagtaagattcagaggaaccacaattcaagtaactgcttatgacatacgacatacaatgagggtccaaagaccacggaccaacatctttaaagtgctgaaagaaaactgtccagaattatatatctagcaaaaaccaagaataaaggttaaatgaaggcattttacataaaagataacccagagaattaatatccatcagatatgcattacaagaaattttgaacaaagttcttcaggctgaagggaagtgataccaggtggaagtttggatctacaggaagaaatgaagagcattggaaatgggtagatataaaacactactgttcttcttaatctatgtaaaatacatattactgttcaaagtgaaaactgtagcatcatatggtggaatgtaaaatgtcagtaagttgtaatacataaacaatatagcataaaattgggaggaatatagttgcaaggtttccacaattgacatgaagtggtacaatattatctctaagtaaattgtggcaagttattaatatacattgtaatccctagaacaacactaaaaatgatgcaaagaggcacagctaaaatcaaataaatataataaaaatctacaatacattcaaataatccaagagaaggcagaaaaagaggaatatgggaaaaacagagggggaaagcagaaaacaactagtgaataaagatttaaatctgaaatatcaataattatgttaaatgttaataaacatggactaaatttgaattaaaaggcagaatgtcagaatggagaaaaagagcaagacactatcatgtgctttctaggagatatgtattttaatataaaaatagagattggctaaaaacaaatggatggagaagggcttatagtatgtaaacagtaagtacaagaaggcttccgtggctatttgatattaaatcaggtaaagcagacttcaagtaagagtgttattaaaggtaaagagaagcatttcataatgaataaagaattacttcatcaggaagagacagtattcataaatgtgtatgtggtataataacagaacttcaaaataaagtaaaattgggagaattaaggagagaaaacatagctggagattttaacaacttgttctcagctacagataaaggagctagacaaaaattagtaaagacttagatgatctaaataacattactgaccaacttgacttaactaatatttatagaacactatatccatcgagagaagaatacacattttttttccaaatatacatagtaccttcaccaagataggtttatgctacgccataaaccatgtgtaagtaaatttgacagaaataaaatatagaatgtgttctcagaccacaatggaattaacaagaagtcaataacaagatagccagaaaaatggaacctttgaaaattaaacaatatacttttaaataacatatgggccaaagaagaaagcataaagagaattagaaaatattttgaactaaatgacaataagaacacgacatattaaaatttgtgggaagcaagtgatgcagcacttagagaaaaaagttgtaactttaaatgtttatattagaaaagaagaatggcctaaaattaatgacctaggattccactctaagaaactagaaaatcatgggaaagtaaatccaaagtaagtagaagttaagaaataataaaaagagcaaaggtcaatgaaacagaaaaaaactgagaaaattaacaaaaccagcaaaaattgatgctcctctacctcgactaatcaagaaaaaagagaatgcaaattagcactaacaggaataaaagatgatcatcaaaaacaagaaaagcctgagatcattaaagatcctacaacattaaaaatataataaaatattataaacagctttattccaacaaatttgacaacttggataaagtaaacacatttcttaacaataacttactgaattggagacaagatgaaacagaaaaatctgcatttcatatctaattaaataaatagaatatatcatcaaaaacattccttcccaggaaaaaagctccagagctaaagaattcactggtgtttgtcatcagacatttaaggaagaaataacaccaattttacccaaacagtttcagaaaatagacgaggtgactcttccaatttgtttgatgagtccagcataatcctaattcttatgttttcttctaaaagcttcatggttttaacttttatgtttatttttgtgaaacatctttaatttttgtgtttgacataggtataggctgaaaatattttcatgacttgggtaagcaaagctttcttgggaacggaaaggacacaataaccataaaagaaaataaaaacttataaataagaccttgtcatgccaggtgtggtagctcacgcttataatcccagcgcttttggaggctgaggtgggagaattgcttgaggccaggagtctgagaccagtctaggcaacacagtgagatcctgtctctactaaaaattaaaaaaattagctgggtgtggtggtgcatacccatagtcctagctacttgagaggctaaaatgggaagatcgcttgagcccaggagttcgaggttacagtgagctatgatcctgccactgcattcccgcctggaagacagagtgagaccctgtctcaaaaaacaaaaacaacaacaacaacaacaacaacaacaacaacaacttcagggagagcataatttcctattccttaagcgtgggctgctcatagtaacttcctttctatgagtagagtatggaagaggggaaaaagaataaggttattgtggggaaacctgacaaactactttagccaagtgatcaaggtcaacatcaacagtgataagtcatgttgatatgatgtaatgaagatggcactctatctctgtgctattccttccataaacccataaattcagactaatcacaagaaaaacatctgataaatcccaagaggggcatcccacaaaatagccgaccagtactctttaaaactatcaatgtcatcaaaaaaaaaagagaaaagccagagaaaatgtcacagcaaagagaatcctaaggagacatggcaactaaatgatattaatatagtatcctgaatgggatcttgaaatagaaaaaaagatactgggtaaagactaaggaaatatgaataaagtatggattttagttaataataatgtattgatctgggtttattaattgtcacaaatgtactgtacaatgtaagatattaattttaggggacactgggtgggaggtatatgggaactctctgtactatcttttcatttttctataaatctaaaactgttctaagcaataaagtctatttttgaaaagacatcattaagaaaatgtagagatgagtcactgactgggagaaagtatttgcaaaatatatatctgacaaaggactggtatctaggatattacaaaaaaatttctaaaactcaacaataaaaacaactcaataaaaagagacaaaatatttaatggacactttatgaaataagatatacaaatggctaataagcatgtgaaaagatgctcaccactatcattagtcattagaaaaatacaaatcaaaacctgaagtaactcaggaatggaaaaccaaacactctatgttctcactgatatgtggaagctaagctatgaggatgaaaagcataagaatgatacaatggcaagagataaaagacaacaaatatggtgcagtgtatactgctcgggtgatgggtacaccaggttctcacaaatctccactaaagaacttactcatggctgggcgtggtggttcacgcctgtaatcccaaaactttgggaggctgaggtgggcggatcacctgaggtcaggagttcaaaccagcctggccaacatggtgaaactccatctctactaaaaatacaaaaaaaaaaaaaattagctgggcgtggtggtgggcacctgtaatcccagctacttgggaagctgaggcagaagaatcacttgaacccagaaggcagaagttgcagtgagctgagatcacgccattgcactccagcctgggcaacaaaagcgaaactccatctcaaaaaaaaaaaaaaaaagaacttatgtacaaataccacctgtacctccaataacttatggaaaaataattttaaaaaaaacacaatgagccatatcattacacccacctgaatggctaaaatttaaaagaataaatacactaaatgttggcaaggatatgaagtaattggaaccttacacattactggtgggtatgttatatggtgcaaccacttccaaaactggactagcttgcattttcttataaacttaaacatatacctactctatgaccaggcaattccatttttaggtattttccaaggagaaatgaaaacaaatgtccacgaaaagttttatgaaaggatactcatagcatctttattcacaaaagccaaaatctgttaacagcccaggtgtccatcaataagagaatggacaaactaactgtggtaaattcatacaatggatgacatctctgaaataaaaaacaaactactgatatatgtagcaacatgggtgaatttcaaaaacactttgaatggaaaaaacacttataaaatagcatatactgtatgacttcatttatataaaattatagaacaggtcagtctagtctataacagaaaacaaatggaacattggttgtctatggaagtgggagcccagatagactgggaaggaacacgagaggactttccaggacgatggtaagattctaattctcagtaaaggcttggttatacaggagtatgtatttttccaaacttgtcacattgaatacttatgatttctgcatttcattatatgcaaatttcatctcagaattaaaaaagaactataaacaactattaatggtattcatactggtattgattcattaatggtgttcatcccacagtttggcagaagattttgtaacacataaaagaaactaagagactaatattccaggatatataaagggtcttacaggtcaatacgaaaaaggcaaacaacccaacagaaaaagtagcaaaatggcttagcaaacacattacaaaagagaatattcaaatgaccagtgaaaagatgctctggtggatgctgtgtactgggcagacttcttcaagagttattcctgcagctgcttgggtgctgctggcagacaaccttgtttttaagttcagtatgagattctcagcacaattttttttaaacttcagaaattataattattttgccatttatgttttaatatcaactataattattgtgtttcttttttcttaatatactttaagttccactagcaagactaataaagaagaaaagagagaagaatcaaatagccgcaataaaaaatgataaaggggatattaccacggatcccacagaaatacaaactaccatcagagaatactataaacacctctacaccaatagactagaaaatctagaagaaatggatacattcctggacacatacaccctcccaagactaaaccaggaagaagttgaatcccagaatagaccaataacaggctctgaaattgaggcaataattaatagcctaccaaccaaaaaaaagtccaggaccagacggattcacagccgaattctaccagaggtacaaggaggagctggtaccattccttctgaaactattccaatcaatagaaaaagagggaatcctccctaactcattttatgaggccagcatcatcctgataccaaagcctggcagagacacaaccaaaaaagagaattttagaccaatattcctgatgagtatcgacgcaaaaatcctcaataaaatactggcaaaccgaatccaccagcacatcaaaaagcttatccaccatgatcaagtgggcttcatccctgggatgcaaggctggttcaacatacgcaaatcaataaacgtaatccagcacataaacagaaccaaagacaaaaaccacatgattatctcaatagatgcagaaaaggcctttgacaaaattcaacagcccttcatgctaaaaactccataaattaggtattgatgggacgtatctcaaaataataagggctatttatgacaaacccacagccaatatcatactgaatgggcaaaaactagaagcattccctttgaaaactggcacaaagacagggttgccctctctcaccactcctattcaacatagtgttggaagttctggccagggcaatcaggcaggagaaggaaataaagggtattcaattaggaaaagaggaagtcaaattgtccctgtttgcagatgacatgattgtatatttagaaaactccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaactcacaagggatgtgaaggacctcttcaaggagaactacaaaccactgctcaatgaaataaaagaggacacaaacaaatggaagaacattccatgctcatggataggaagaatcagtatcgtgaaaatggccatactgcccaaggtaattcatagattcaatgtcatccccaccaagctaccaatgactttcttcacagaattggaaaaaactactttaaagttcatatggaaccaaaaaaagagcccgcattgccaagtcaatcctaagccaaaataacaaagctggaggcatcacgctacctgacttcaaactatactacaaggctacagtaaccaaaacagcatggtactggtaccaaaacagagatatagattctcagcacaatttaaatgctgctgaggtctccacagcagtgattcaaacaccaccccctgccctcactaccaatcagctgcagggaccttggataagtcactcaaactccctgcagctcctcttccctcctcatctggaaaacaatgaggaatagaatcattttttgacctgcctgcctccccaaactgttgtgaagaccacattgaaggctctttctggcctggagggtgctacctacatgtaagtcatgctcagtaacaagagcagcaaatgatatactgggactcaaccccaggactctgacaccctccttagcaccattgccctcagagcagatcctcagatttatctcccaatggctgcttagctggaatgtcacctatgtagagaagcccttgtaatgattaaagctaaagtcacttactctgctttcttaacaatgaaaattatactatcaacaaaaaattgttacctgctccttctacctccaggtaatgatgcactgttgcatccacagaatgaaatgttgtagctagtgaacgataaaaaagctgaaagtcctcagatggtactattgacgggtgatcctagaatggcttaatgttcacatatacatatgaatttatacacacaaagctcacgaccattttaaggaagctgtatcaccccaccagttcagggatgagctccccaaattgtggaactctgttctctgaccagagttgatggagtacactacaggaagagcccactgtgtttgtgacactcgttaacctctgatagtaacaatggatggcacagctgtcttggttccatctctgagtgtggaacatattgccataatcggactaatccaacacttcatgtctggcctcgctcagaactgtgctgggttaagtgcatctaatacataggaatcaatcctcaaaaacagccctgagagacaggtcttgttttcttcactcattaaatgaggaaatggaggcctggggaggtgaaggaaattgcccaaggtcacagagctggtcagtgttggggccaggacttgaaattgcatgcccatcatggtctctctcctgagtgtgaaccaatgcctcttctcctacactgtgcagcctatatgaatacattctggggaaggccaaacatgatgaactcggtctcacagtctgtgacccaaagggcccaaatgttactcagtgaccccatctttcagtaaactctggaagcacagtgttctcctgtccttactagggccaccagaaggatgcatggaaaggatgactgtcttgacttccttccctatggcctagcatgtctagcagtctagacacgtctagcagtttgctagttatttgtgggggacactctagtttgagtggagaaaggtttcaagttacaagcccacattgcatttgttaacaggatttcagctcaggagtgctcgcctcaggctgaccagtcagtcagtccaatgaaaactgtcccgaaacgaggaaggccacctgcctaggacaatgtcctgggagttggtgcccaaacgtgctgagtgtgaggccaaggaaccaacacagcagcatataagaaggctcttttctttcttacaaacctcatccccactccgcacaagctgtagctacaagaagcctcaaatcgagaagagtttttgagaatggctaatatggagcacagaagaaaagtccagtggaggactcccagctaagtaaaggcaagagagtaagggtgcaaaactttaacccctttacctccctcctctactttcctgattgctatccctgtctgctgctctctccggccaatggagccttctgctgaaggaacaagcagcaatcagaactagggattggttcaagattcagacaaaggccaagtctaggtttgccaggttcagagtagcaccctgaccacctagtacacccatacctcccaaacacagagaggcatacctgacccataaatcttctgaacccacaaatatttactcatcaacatctcctatgaaccagccactctgctggttgctaaggacaaagtgatgggcaaagccaacatagcccctgctctctgagaaaaggcattctagttggagaagagagaaaataaagaaatcaacaagtacattatgactttacaataaatgttataaataataatttgataataagtgtcatgaggacaaaatatagggtaacgtgatggtgactgtggggggcaggagattggcactcctagtcaggaggttcagggaaggagacacagcatgaatacactcacgcatcctaagcacacatgcaatgtacaaacaccccaaaataaatcaatcttttgctcttaaacacacacacatacacacacacatatacaatcatgggatgtcagggatggaaaggccattggaggttacccagcccagtggctttcatcgtctaaagatcaatctgtttctttagtgaagccacatccttggccttacccttgctcccccaaggtactaccctagaatgccagaaaagagttttgctgtcactgctccagtcttagtaccttaatgtacacatacacatttcaaggcccaggatacagaatggccctgcccaaggtcagaccatgagttggtgacagttggggactgggcccctaaccctccccactatgcctcgcataggcttctcccaactctcatctgtggctgcctgacaagtgatgtgtctaggcttaggatggttaatgatctccctaaggaatgaggggagcctggtgaacctcaggtaccactgaggacagaaaggaagaagccagatgggaattggcacacctgtctgaaaccagctacctttatcatgggtagagcactgcaactaatgagcattccactgtctgccgaggaaaaaacgtaggaagcaaggtggtgtgtgtatgcatgtgtacatgtatgtgtgtactcacgcatgcgcatgtgtacaaaggggaaatccatgttatccggaggcctggaaccagctttaaggtgggcatggaccaagggctttcaggggcaagggccggcaaagacaaccttctcttggcaaattgccctcaggacccacacatacttttgaaaattaatgatgctgaagaatctttcactcgaatgagatatatataattttagaactagccaagtcgtatgaggaaaaatgtgtgtgggcttggaaactggtccagtctgggtgaaaatctgagttctgctgttaatctcctctggaatcttagacaggcaaccacaaaccttactgggcctctgttgtcagtgaaatggagataataatagccatctttcatggagtgtctgccttggccaggctctgatcaggaaaagaaatcctctcattccagtccaataacagccttgcaaggtatgtcacttcagtgctgcttcttactccagcctctttgcctgagagtctccagcagagatggcattcacgtagctccctcctcactttctcctcatggtgtttgtctgtacccactcccgatggatgggtgggccagctctgtactcaaatcagggatgtttagggatgtgctcctgggcacacaatggagatgactattagagcccaaggtatatgtgcagtgtcttgatgcttgttttatatgccagttgttcccacctagctgggagctttccatagacagaagcagggttggcctccttgctggagccatagcacccagcccagtgcctggaaaacagatgcccttggtaaatgtctgttgaattgttaatgatgtaaacttttgctctgtcacagataaattccttggtagactcaagtaagttaagactgtcccaggtcagtgactgaggctgagacaaagatcctagaattgaagatgtcacaactagggagaagcccttggagatggcctaattataggacagatagagacctgcagctcaatgagaggaagggaccacctaaagtgacccaacacgctaggagcagggacagacccagacctcacacctcttgatcttgggtgatcatgcatcctttccagttttccgacctttctcaatccagcaaaggtaatccaggaaccccaaaactaacaagggccctggtaaacagagtcaatgccctcccccaacaaggcccctcattctgccctggcttcaggccctcctccctgaccttgcaagcatctcaggaaatcccattctggccactatctgcttcctcccagcatccgggcccctctgctccaacaggcttgctgccagcccatcccccagccactctacacttgggccacagctggttcaggcttagggtccccagtgtcctggctaacagccacggttacttcccagattccttcccagggttctgtggagataaccagagggtcactgctgccctgttgtagccagtccctcatctacagggcagatacctacagttttccagcttctgaggtaaggactggggcaagcaagaatttatagactggaggtccgggctgcaagtgcctaccacctctctcactgcctgtgtgcgagacttagggcaggctgtcaaaggtctgcttcctgtggggctgagagggttcaatgaaaaaatgcatctgaaaggctctctgcaatgactggtgcccagaaggggttctgtaaatatcagctttccttccctggggaggacttcagggcaccaggaactcccagcgattatctacagtaggtatgtgtgcatgagcattttatccaggaagaggatctcatggctttcacgggagtcgggcaatgacagaccgcatatacaaccgtggtcccataagattataatatcatatttttactgtaccttttatatttttagagacacaaatacttattgctgtgttacagttgcctatggtattcaggacaatagcctgctctataggtttatagcctaggagcaatggactctaccacatagcctaggtgagtggtaggctacatcatagaggattgtgtaaatcactataggatgttcacacaaggacaaaattgcccaatgacacatttctcagaatgtatccctgtatttaagtgaagcatgactgcataactatctctattttacaaatcaaataagaaaacaggattggagcagtacagtaacctacttgggtccatggctaataagcagtgagcagagccaggattccaactttggcagtttggcttcggagtctatgattttaacaattgtaatagaccacctctcaaaatgttctctgttactctgtcctatatcctctgtgcctttgtcttactgccctgacctcatcaactatgccttgactatctcctgccctcaccacacacccttcccccacccctgctgtcctttcccctagtctccatagtcagggtagcaataggtcatcctgcactgcagtgtgggctcgtcccagatcagtgtctctggtaccccgctaaggagccccataactgttgggtctttaggtctcagagccccatgccctgtgctggctcagtgcaggccccacaggagataggggagctgacactcaaccaggctccacccactttccacctagaggaaattctctagatcagaggttcttaaacttcagtgggtcatggaacctcttctagactcccatgaaagtcatgagtacctgcctatagggttgtggcaagggttaagtgagttaatgtacataaagccctcagaacatggcctggaactgggcaagcactctgcacatgcttgttgctactattccggctcaggccagtgaggctagagggcagagcacgtggatgagtgcagtaagaggtgaagctggaccagcaagctagggtcagatgggggagtgcttgactaggctgggctgaagagtctgggattacatctgcacatgcaggggcaccatcaaccatttctgaagagagaaccaagacacactaactaactgtggaaagattatacaaatatgatggtggggctagacacggaagaaggtcactcatttatctagtcagccagtcattcattcactgaactcttacccatgccaggctcatgttagacctgaatgaagagtttccaggaatgagatgcttcaaattccacataaaggactgaatctgtgccccaaagtggctttcgcttcaccactttctccgaaaaaatgcaatacccctctttcagggaagccagggcctaggtgggcacatgggagtggaacccccagctgaatctatcagtagtcaggtaagtttgtttggctaatggccttgcaggcagaaggaatctgaggtaggcagaataacagtccctcccaaagatgtccacgtcctaatccttggaacctgtgaatatgtgaccttacaaggaaaaagggacttggcagatttatattttggatttatacgttggaatgagatcattctggattatccaggtgggtccaatgtaaccctggattcagggttcttataagtaaaagcaggaggcataagggagggtcagagtaagagtaggtgatgtcatgatggaagcagagtcagagagagtcagcaagcgtgggggtaattgaaatctgaagatgctatgatacttgccttgaagatggaggaaggggccacaaaccaaggaatgggggcagcctctagaagccagaaaaagcaaagaaatgggctctctcttagagactccagaaggactgcatccctgccaacactttgactttagcctcgtgagacccattttagacttctgacctccagaattgaaagatgataaatgtgtgttgctttaagccactaagtttgtggtactttgttacagcatccacaaaaaaaaaaaaagatacagaatctggggttaaaaaggaaaggtaaagctacgtgtgaaatctattttagaaatagaaccaaacctggtaaaagaaaaccacagggaaatgaaagcttatttagcaagtactctgggggagtatggatgttaacctgaagggagattcacttaaatctttacctctccctgaacaatctaatttattccagatgggttacagaatgagatatatgggaagaaactggtaaaaaacagagggagaacaggatggtgaagggtcttggaatcacgacataagacgaattaatgataagccctgagacaagaagatgaggggtccatggtagccgtatttggaaagtgcatacagaggacagatccaggactatgtgggttagacattttggggagataaatttcagctcagaagaaggaaaactttccaaatgattggcactgtctgaaactggcacaggtgccttaggaagaagtgagcagcatgttcctagagatatttaaacacaaaattaattcttgaaaggggattcctgaactggacataggattttggaactggtaggcccctcccagatttgaggttgtgccaaataccttctgcagctttgtgaggacagggccaatcagtgctcttctttgtctggacttgaaataaacaaagaaattaatatcagttcagagaccaattcctctcagctccctgatacaagaaatatcagagagaacataaaatccatgaagtctgaagtgcatccaaggatatcatccccgaacaattcctcagtgctcctgggaattacaaggaaaggttaacagatttgcctaaattggctatggtcccatgacaaatggagtggtctctgcatgctgcattctgggtgtgcaggcaatcaccaagggcagaggggccttgatgtggcaaggtaggaggacaaggaaacttcaaggttgatgccttggcgggacaagccagttgcctgccctggcccaacctccccttcatttcaacatgtttaggttatcaaccagtaccacctcctgcctcctaagttaacttcatagctcagcagagttcctccttgttttcttccacctctagggagtttccaaaaagaagctgattttaacaaacttaacttagactactttgaagatgaggaaacagagacagggaggctagaggacataccagcagagaggcaataggggctgtcagagtcaggaggaggatggtgggtactgcacagactaatcttccctggcttgctaactagtgcacaaaatcatgacttatcagagaggaaggggcctgggagtagccctcctgtcccctttgcttgtataggaggaggctaagtctctctcactggactgacaatgtggcctccctcctgctaggctttcctcccccaactttcaacctgccctgatttatctcttcaaaggaaccccaccttaaataccagacaaatcccagcttggttctggaaggtacactcataacctaacaatacttggcagccacaaaacccccatcccctcaccaaaggccttcatgactcccctgtctcttctccagactctgttcagattttctgtggcctagtaaatgcttccaaacccccttccccaggaaggccagtgggaggggaagaatgtgttaagccagatacttggctggtttcagtcaatgtgacattaaagatttgctaagtataatttttcccttctgcaaacaaatacaatttatagtcccaggaatgacatcttgctgactgatgatccacatagttcaccaacagcctgcagagtgtcccttcttaggaaaatctttcctcaagccctggtaagattcaagatcagctaagtagcaggctggaggtgcagcctgtctgcagttctgctcttctggatggcttggaagaggaaggaacaaggaaggaagtgttgggggcctggtttttatggccattgttactttactggatccttccaacagccctaggatgtggccatgtgacccctagcaagtcatctaattttcccgagcctcagtttcctcaagggttagaggagggcaatcatactgcctgccaccgacaaagtacttcataagaagctgttgctattcccaccatgctgagcacccctgccattcaccaccacctgtgtcacaagatatacatacagggtgcctctcatgggccagggtctgtgccaggtgtgcacagagattaaatgcctatatggcaggacactatttagtctccagcttacagaacagggactgagctcagagacactgagtaacttgcccaagatctcttggataggaaatgtggcaatggagactgggagccctgccacctggctcccgggcctcccctcttaactgtctctgctgtactgcttcctaactactgattctccagtgccaggcatggttgttaaactgctttaccaaaaactgtggggatgcaggaaggctagacatgagttccagggcatagcccccattgaccctgccctagtggggttttctggatgggggcctctcctctgctcaccctacctgacataaaccctttcatgatgtattccccccccatggtcactgccttctcctgccccaaggccacactgaaggctgtcccacatctagcctgccacacccagggtggcatcgcccctgggatctgttccaggtgcactcagcagaactggccaagcacatgtatccatgaaactagctaggtaggggggctcatgtcatttaatgaactttgctcctccaatacagtcaaagggtgcattaaccacacaatgtgagagcagaaaggaaagaaaaaaagctgggacataactttatggactcacataaaatttgacatgtatttcaaatgacatgtatttcaaaatgttatttcaaaacactgatagtctcaccaatatgtccagcagcaagagaacagggggaaaacagaatgacaacattaggttaccgtcttgcctttaattctgggggtttagccatcacagacaaatgaaaatgcataaatttgtaatttcttctctgttaaaatctgaaattctaatgtaattctagtgtaatttagtataaaaatgagtccattctaattcactcttaatatgtaattgagcacaaaagatttcttactgttatatatctgttatctttcattcattcatttattcaataagcatgtgctgaacttttactccatgccagtccctggctgggccctgaaagaagaagggagaatatagaggtacatcaggcttaggccctgaccttgagccttgtggtctagcagaggagacaagacaggagcctaaataaccaagtggaatatggtcacagtttcccaggaacagcaaagcgctaggcaggaggttccaaggaaggacagaagacttgtagctggaaaaagaacttagtaggcttgcccatcctctggcttctcatgatgaccaggaaagggatgtaaggctgactggcaacatgggtcggaaagagtcctgtgatccagtcccaggttggcagtgagcaaagtgcacagcctgggggcaggtccctgcatccctcagggcctgttttctcaagtgtgaacaagagttttagaccccaaaagttctatgggcatttcaagggtgaggagtcagagccaagtcccagatgtctgggcttcaaattcctggacttctggccatccttttgccatctccaaccacacagcagctagcattagctcagcctttgagtcagaatcatagcgcctaggaaagagggctaaaattagtagaggaccaatgtactttctgttgccctgatgtcttgagagcatcaatcaaagacccttgttctaaatatgtctcaaggcaagagcaatgctaatgccaacaatgttaaaatgctcagcaaacaaacaaatatacttctctcccatcttcagtctctctccatcccattttatcttcattttatcaggtacaaaacaaaatacatcagaatggatgaaatacagctcaagtgagctgagaggtaaattaatcgaaatgcaggagccctcttgagggccattatgactggccactcttggggtttcctggataccgctgggaaccaaggcccctcttgagcaactcagcacacagatgtttctgccacttatgatggcctccgagcactgagctggaagcctctgattgaatagggctgtgggcctggaaggagccaattttcccctctatccctctctctgccacttccaaagagttggtggcattgatattcactcccatactgaccctgaccccgacccctcagttgcttctgaaaagcaatagtacatcaagactccttatgggggttcattctctgcatgagttttccagggatgtcatacaaattgtcacaaacaggctggcttatgacagcagaaatttattctctgaaggctctggaatagaatctgttccatggctttctcctagcttctggtgactgtcagcaatctttggtgttcctagccacagtgcttcagtttctaccttcatttttacattgccttctcctctgcgtgtctttttctcttctgtgttccacaaggatacatgccattggatttagggcccaccctacatccaggacgatatcatctggaaatacttaattacatctgcaaagaccccttttccaaataaggtcacattcacagtttctgggtgaacatatcttttggggagggatcccactcaatgcactacatctccctcagagctgttgtgttttccagattcaactggcagcactcaggcagagagagattctggtctgggcaatcagtgctctcatccattttattgaacaagagcattctggaacacttggctcctaagaccccttccaatagagcacagaacgaactctggaactaggttccctgaatttgcatccaggctctgacacttcttagctgctgtgtgacactgggaaaatcacttcacatttctgtgcttcagtcccctcatctgcaaaatagggatgataacagtacttacccacaggggaagagtaaagcattttgttgttgttgttgtttgctattctgcccactaccttgctcaaattgctattgagcaagctcatatcatcacactcctattcccagaagtagaatcataactggaactaagcatgactagaacagaactagaagcaaccctagaggcagttactaggcatttatatagatgctcatttacaggggaactgtcacaatactgagactttttaagcaaaagaaacaaaatctataagaaaatgtggcacatatacaccatggaatactatgcagccataaaaaaggatgagttcatgtccctacatgaatgaagctggaaaccatcattctcagcaaactatcgcaaggacaaaaaaccaaacaccgcatgttctcactcataggtgggaactgaacaatgagaatactaggacacaggaaggggaacatcacacaccgggacttgttgttgggtgggggtagcggggagggatagcattaggagatatacctaatgtaaatgacgagttaatgggtgcaacacaccaacatggcacatgtatacatatgtaacaaacctgcacgttgtgcacatgtaccctagaacttaaagtatataatatatatatatatatatatatatatatatatatatatttcaaaaagaaacaaaatctataccaccaaggaaatatctcccttgaaagtagtccccttgagaggctttacacactttcctaaagctgctgttgctcaaacccgatggggctgtggaagtggcccttagagacaatttatgtataccaccacccattggagccaaatccacacttccctggtttaaccatccaccttctccacattctctcagaaagcttttgggctattgagaataaaagccaccctcaaatgataaaaagctgttccaggaatggctggccagctctgaaggaacactctcaaacattcacttaaaactcaggttggaatatttaacaacggtgagccggccactatttcccagcaatgccatatcccttatttcattctcaacaaacctgtggctagatgctttattgcccctttattaatggggtaactgaggaccaatgagggtaaccagcttcctcaaggtcacatacctaggccaaagcaaacgggagggctgaactcaagactttttttgcttcctaatttatcactctttccaccactccaggacgaacacagatgcatcccattactttagaggcaaatcttacatgttcaacataattttctgattgtctactttgtccttattttctaagaaatatcctttggaaaagttagtatgagcttggggaaaataaggggtcttagtctgctctacactgtaggctgaggccagcatgttgctctgcaatcaacaaccatatgtgaaaatactaagagatgccagtgcagactggtcccactggcctttagggggtaccctcatcttcatggtcctgggcttccttatattcatctgtaaaacttgcatagtgataacaggagagacagggttgggctcagagggattttgtcaatctcagtctttcctgtggttagcaactggaagttcttcagtgggagcacctttgagctgtcctacaaataacagcactggcctaggaaggggttaacactcagagtcctgccagccaaatcaaccagcagaagagcctagagagcagacagctgcagaggtgtgcacgattcctagggccgacccaaggtcgcagctcctcacgatggctttatgaaactggaacaaagcgaaacggggggaagcaaaagggagggggacaagcacagttccttactctatgcagaaaaataggacatttcaggatggaaagaggccagaaagccactgagagctgcctcctcttttcccaaccatgaattctggtgcagtataatcttcttcctaatgcttgtggaaccatttttaaaagcaaaaacaaccattcccactagtggtttccattattgccattggtgatttttttttcctgtgctgtaaccatcctctatggcaggagatggcaatgcctttcctttggtgctgagcttccctagtgatgctgtttctccacaggttctgagctccagggcatcactgtccttttctgggctgaaattcctgggccctgtggtcctcagtcccaagcaagccatgcttgccattctccatcccactatggaataaaatcctcaatcccttgatgtttagaaaagaaatcttatctcccaggaggacttagggccttggcatatccttcactgaaggaaaaatccccctcacctcagagagaaaagatgcctaggcctccctgtgagtttaattttcccaagaggatttgctgccaacttggagaaaattcccaggccccaagtgaaggtggctatttctgcttttccctccaaggctcttatccagcctgctagtttctggcctgtgtcagagctaatccttaatgacagacagtttttaaattatcagttacttgtctgagtgtttgggcttacttcctggtccccgctgtgggagttaactcagaccagccctggtaaggagcctagaatttccttcactttgctctgacatgcagtgccacctgccacccccaaccaaataaattatgtatttgagaagacagtccttgttgaaggaggcagagacagatgtcactactgcattgtggccagaagtgcgcccagtggcgagctttctcttgcctccaggaagatgcctctgtaggtcgggcatcctccgctgggctccagtgttgcccagtgcatactctaccattgcccttaccacactgcattctaattgtctgtttgcttgttggccaaccccagtaggagtgaggcctgtaaggagagaaccatggtatcagtgtcactagtcttctcagaatagagcagagggcctgactggagcagcaggtgcccagtaaataaatattggttgagtgaatgaggaataaagtagccaagtaaccttcaatatggtgtccaagtgaaaataaacaaaggactaagacaggaatgggtcagccaatctgcctcagtccctgccagcgcccacctctcactgccaggcttaaggcctctacccacagtctcagtcttggccttacgatatacctgacagggcccacccagtagcctctatcttgctgccctagagccagcagctggtgcagctgggggagccctgtgaccctgtgcctatagagaaatagtctttactgctgccaccatgttggccaagtccatataggtgggctgtgccttgttttctgtgctgagcattccagcttcttgctggacctgggtccctgccttaagccccaatgtgtttggatcaggtcctgtttccctgctctgctttagtgtggcctccatcagacagacaaacccctctctccccagctgctgacagccttttgatgtgaatgacttggcatctggcaatgtatcaccaagcaccagacttccagtgtcccgagcacctattgccatgctgacccaccagatgagcccctgaacaagccacacccacgttgtcctcaccacttttggcaacgtccaggccttctcagcagcttttgaaaggacctgtctctgtagccccataaaggggccaaagacgcagtgcggcccacaattgagctcatccatgttactgccaagggagtgaaaactgatcccccaaagctacagagaacaaagcattaagtattaaatggaagctctgtggagactgttcctaagtcagatttaatggagcacttgtcaccaaatcctcctcaacacctccaatcgctactcaatcacactggtcaaaagcagctcttcctggaagaaacacactttccttacacactgatgagatcccagtgcacagccttcaccagagtactaaatgggatagttgcaaactcacctcatgtcaacacgtcctcagtaatagccactatttccaagggcatctctgaactactcttctcagggttcatatttcaggataggctcatgggcaaggttgcattgtgatgaaatgcttttgtatttcagaatataaattcccctaaatggggcccaagaaatgctcaccttcactgcagtgccctctatggtgataggacagatagcactagcccaataatgaacctttattgagtgttcccaatgtaacccaccctgtgcctgacccttcccatttactcctcagaaacacttgacagaagggtgaagtgactcacccaagatcacacagctagtaaggagggggagacaggattcctcccaggactccctgaccccaaagtcctggattgccacatagcttatctccctattcttgggctgtctcagtttgagtctaaacttcaaagcaacacagaaagatggagcccttgctgattcaaggtgttgaaatatcgggagaaggttctcctcatagctattggcttccccaaatggaaccacctgtgggtctgtttctaggtagatgaacatgaggtagcttcttacgatccaaacttagatactctgctagcaggggcccaggtgccacctggcctttatggggcaggggtgccctggcactcagggaagcagggccagtatgatctagtcaaatgctggaaagtctatcttctacagagcttcaagtgtgaccccacacccatggatcctgccatagctgctgctctatatcaagccctgtactctgaggtgaagcggaccctgagcctatcctcaaggagctcagtctcttgagcaaccagagtagctgtggccatgctgagacaaaggagagggtgatgggcaccacaagggagggtgaagtgatcacagcaggctgggggccagaagggcttcctctgagctgggccttgaattatagatctgattttagatacgcaaacatgataaaggaaaagatgtctcaggtatagggacgagcataaataaaggcatgaagtcaaagcaaaggctcagagagagtcacggtataatagcaaagaccaaatctggatggggccagactgtgcatgatagacttgcactgcagtgctcacagccactgacaactaggcagccacgatggttaagcactgggccagatgctctgcatttattgttatctcttcaatccttgcaacagctctgtgaggcattattatcttcctttgatggatgagtaaacagaagctcagaaagaaaggtgaagtaattgtccaaggtcatatatgagtatgagatagagctggcattcaaaaccagatttgcttatatctacagccaaccatcttttccactgctctgcactgaagagatgagttaggaaaggcctttaatgtcaagtgtaggaggtccagctccccaggaagtgatggaaaacagggcagttgggtgagagaatgaaatttgagaatgggaaggtgcccagattttggcagtggcaactgtgctacctgcactaccaaaacgttttcaatttgggcagcatcttggatgccaggttttatcaggaccagggggatgtgagagatagatgccttctagggagccaaatgccagagaaagggtaagggaagtctcaaagtgaagtttctgtagagctaatggtttctaccatggtctggtagcaggctgcattcccagcagcctaacaaaggaaaaacataagcccttaagatatgattcatagttaccactgggggaaaatgggtaaagtatacactggatctctttgtattgtttcttacaactgcatgtgaatctacaatgatctcaaaattaataaaagtttgattaaaaaaactaaaaatgaatttcctgtatatttaaatcttgcccattgaaaatatgccagttttcatattaacaccttgatcctttggattgggtgactctttttttgttgggaaactagctgaggtgggggctgggggggatagcattagaagaaatacctaatgtagatgacaggttgatgggtgcagcaaactaccatggcacatgtatacctatgtaacaaacctgcactttctgcacgtgtattccagaacttaaagtacaataaaaaagattacctctccccccaccaaaaaaagaatgattctatatgctccaaatcacatctataagatgggttgttctgagtccaagccacctaaaaacagaactgttgcctggttttgctctataggcattctctagcctcctcacttaataacaataacaacaacaataaaatatgttcctaaaacagttgacaaaagctttcacattcattttcccatgggcacttcgtaacatcccagtgaggtcagtagagcagggcttttaaccccattttaccaaggaggaaactgaggctccaagaagctaagccattcacctaaggtcaagtgctagaactcagatttgactgcagtaattctattccaagcctgctgctctttccattctgttaaaggtaccagcaaaatgattttctgaaaaacggaattgtggtattttccaagctgctcttgatcgagataaagtatttacatgtggccttgtcctagaaaccacatctccagccacctggaacccagtacaactgctctaagtccaagcaaatgcctcactctgctccaagatcactgcgggactcgaggcggctctcccatctctccctctgtggaagaaaagacttgcatgcaaataaagtgggacatttctatttgcatttggggagatgcagccaaataaaatatgatgaccacattaactaaatattgcaggcatttcctttccagttttcctgcctgtcacccactcaatctggtgtagaatggccatgcaagaatgtgataaatattttttcctttctaaactgggatttcacatgtatagagaaggattagggtgagacagttaactgttgagattttggctttccttgggccaaatatctgtggacagctgaggttgttcaggattgagctatagttgggagggaatctaggtatgatgcagatttttaaggcacgcttagcccaaaatccagggctgggacacatatcatctttgttgtgcttcaggttactcagaggcagatgggccaagaggtggaaaatctttgtaaataaatggatttgagcctagttgctgcttggctgctttaaagcatgatatttttcccacctggaatttgtctcaaaggacaatgaatgagtgtctctgatctggggttatgaaatggttagagctcagcagcaggcaccagggccgacacgaaactctcagtcaggctggcagaacaattcctaccttgaccagaaagcctttccactccctgattatagagcttgaagtataggcctggatacaaggaggattcaagcaggaagggaggtcagagatgggataaggccaactcccttaatctgaagctagaggaaccaaggcccacagaggggcagggacttatggaaaaccaagagcaaggcagggcaaagctggggccagggctcaggctgccagactctgcaggccatgttgcttctccctactccaggccatctcccaccacttgggccacagagctagaggtggacaagctactttccttatcacttgtggcttgacctgaggaaagccccttcccatgacttaggaggaagatacagatggcactgaagacaatgtccccagcaaagaggagccatgagcagatcttggacctatttacaatagaaacaagagaagggccatctattgccaagcccttgtccattggactggcccttccttcccagatgctctgttcaaccttcatcaactcagcacttcactccagggcctggcttaactaggtctttctgtgggtctgatgggcccacatgtaactccaggcagcaatctcccagagaatggagaaaatggatgatgcttgcaatgtgatttttgagcaagtggctgattgactgggcctatcatcttgtttggtgtgtgtgtgtgtgtgtgtgtgtgtgtgtgtgtgtgtgagagagagagagagagagagagcatgagagagcatggggggaggaaggggagagaagggggcagtacctgctgataacccaaaagggagttttgaaaggagaacctagctgcgactctgagaggccaggggttctcagaatttgcattgcagagtgacttcaaactagggtgggactttcacgaaggaagtgaagtggcacctgaaggttagcctgtgtgccacataggacaccaggccataggctaacttggggcatactttacagagcatttccctcatgctcccttgattaactttcccagtgacctgtgtatgtacatgtagtgtgtgtgagggggagtattatccccatttaactgatgatgaagtggaggctcagagcacataaataacttcctatggtcacacagccagaatatgacagagttaggcctcaaacccaggtattctcccttcctatcccattctttcttcattatagacagtataccctagtggataggaggcaggctctaggatcagagatacatgggttcaaatccaagctctactgcttcctggagtacttatttatcaggtgtagtgcttgtgaccatgaaatgagagtacctgattacagcataacacaggcctaaaagacccttcttgactttcagaaagcaagtcagagggaagtgtagctgttggcacaaccttcagcctcttggcattggccatctagctactccatgctaggctataaggtggagagagtgggggaacacagccctttcttcccacaaacccgtgcttgctgcttgccctcacttccttgccctcagcaatctgaacttaggctcccagtcccatccctctgctcccacatcccccagccctggcctaacactcagctccgcagcctgaccctgcttgtgacattccacatgggtacatgagaagcagatcaatgatatttcctgggccttttacccatctttcccaatcccctattttcttctcccatcccctccataaagggaggaaatcatttttccctttagccgtggtgtaaaaaggacacacagacccttaacctgaattcatgggcacaactggcagaaggacttgcagcaggagagcactgctctccctcatccatctattcagtcacttatgcttcatgcagttgaccctcattggcttgggtgtggtcccatgtcagactccataccaggctatgccaggacagagatcaagacactccaggctaggctggacccattgtctttcaccaaatatcctcattttattttcataatcatgcctgaaaataattatcatcccattttatggaagagggaattgaggctcatgcagggatatgatttgtctgttcataatataaataaaaatagtaagtaggctaactaaaatttgaattcatatctctctgtaccctcagcttatgttccttcaatttttccaggctaggcagggaaagagagaagtcagaagaggctcatggagatctcttctcctcccaaaggggacctgggccagatcagagaaagcaaggagcatgggcttctcaactagaacactccatggctgaactgacaaataattacatggaaccatatggctgtgggcttaaacctatctgtgcctcttacaagtactctgctcaattaaaggcaggacttggtagtcctaactggcaatgtgtgatgtggtcgagagagtctaggccagaatagggcagcctgttctgtgtcccaacaatattctgtgcagaccctcccccattatggcccttattatcctaaactttcattacccattgttatgggatgaactgtggtccccctatgtttgtatgttgaagtcctgtattcggacagagggtctgcaaagaggcaattaagttaaaatagggccactagggtgggccttaatccagtatgactggtgttcttataaaagggtgaaatgaagacacagagacacacacagagggaagatgatgtgaagagacacagggagaagacaaccatcagaagccaaggagagaggtctgaaacacatccttccctcacagcactctgaaggaaccaaccttggtgaaaccttgatctcagacttctagcctctggaactgggagaaaatccatttctgttgttcaggccgcccagactgtgctactttgttatggcagcctgagcaaatgaatacaccaatatacagagatctatgttccccattgggccataaatgccttgcggagtgtagcccagcaccagctcagtggataatcagtcaagagctgctgtatgtggcggcctttcccagggtggatgtggagagaatattaggctgggaggccatctctgccccattcctctctggataggtctgaggaggcctgcttactggcccctccctccctgggctttctgccagtcaaagaggacatccttccttacagaagatggctgtgctcctgccagagcatgtgagcagctgcatctgcctgcagggatagttgtgaacaaggagccagcagagatcctaggtagcacgtgttcctggagactttaggtcactctgggaaatgcttagttccagttctcttcaccaaacagcatggggcaaaggccctcagaaccagggtctggcatcactctgccattacctgaaaggaaactaactctccaggaattagagaaggtgtcacaaagtggtgatgttggaactgcagcttgaagaatgaaaaggaaaagacagtagaggaagggagaactccagatataaacaaagtaaagcaatgtacaggtaaatgagatgttcagggaacagaaggaggtctggtatagctgaagcatcaggagctgtggaaggtggtggcccagtcatctggagaggtaaccaggaggtagaatgccagagtgtgaacactaggcctaggggttgggatttcattccaaagtcagtacagatccaggccttgtgagcaggaggcatgactttgcggtgggaagaacagcctttaaatcatgggcagtggaggagacagcctggagcaagggaaacaaggggtggagcttttgctggcacccatgtgagatgagtggtctgaacctcggaggtccaatggtgagtggcagctgagggagaatgggaagtttttagctgggcagctggggatatgatgagcctcctagccaaaatcccaaactgtctggctctgtctgctgtatacatttgtcagtctccttctcagactgtgtgctctccaaagtcagaggaacttctacttctctccacaaaacctactgccaagcctagcccagagtcagggccctgcgtgtagtgaagagtctctcaggaaaaaatatattaatttgcaaaagaaggaacgaatgtcaagcttctgttttaacactgcagaaagaccctctgcctcacaaaagacaaacggaatgaaaggtggggagacttcgttgtgaaaagcagccaatatttaaatctaaaactttagaagcactcgtggaagttggttcccgatagcaaagaggaatttaaacttaggaagtgcagtagctcattgggacttacgttgtcaagaagaaggggaggagagttcatctaaaaagaacagctccatctagcagcattaatccccaatggctttggatcaattttggcttaataatactacaagagaaaaagccccttttcagtgtcaaggaaaatcctgctttcagagagtcactctttgcctatctccaacaggacttaggatgagtgtgtatcacgagctcatctctgaagaagttctgcaaagccctcagggacatgcagcatgagttccatcccctggcaagaagctaagtcctgtgtctatgaatgcatggtcctaccatcccagcatatatgctctggcatataaatggcatcccaatgttacagataggagagctgaccagtaagggaggacttacagttcttatggaatttgtgctcagcagagcaggcaaagccttcaaagaccagggtccacagaggagggtagctaggacaggtcagtggaagagctgtgagtataatgtagagctcttgactcctgggccagggctctttccactagaccatgctgtctgtctctcagactaggccgatacattcaaccagtttgaccattttgatggaattggatgtttgaattagtgaccattaatttggctaatttcttttcttacccaaatgatcaattgtttacattagccagtaaatgagtctaaatgaagtggttgttcaaataggcacttgactatggttgaacatgaagggttttgtgatttagaattgggagttgtctgtcatcacagttaaatgatccatcaaagcgcaacaggttaagaacaggcctaagtggtacatccatataatagaatactatttaatgataaaaaataagtgagccatcaagccatgaaaaaacatggagggaccttaaatgcatatcactaagtgaaagaagccagcctaaaaagactacatattgtattgttccatttataagacattatggaaatgacaaattatggagatgaaaaaatatcagtggttcaatgagataccatctcacgccacttagaatggtgatcattataaagtcaggaaacaacagatgctagagaggctgtggagaaataggtatgcttttacactgttggtgggagtgtaaattagttcaaccattgtgaaagacagtgtggtgattcctcaaggatctagaaccagaaataccatttgatccagcaatcccattactgggtatattcccaaaggattataaatcattctgctataaagatacatgcacatgtatgtttactgcagcactatttacaatagcaaagacttggaaccaacccaaatgtccatcaatgatagcctggataaagaaaatgtggcacatatacaccatggaatactatgcagccataaaaaaggatgagttcatctcctttgcagggacatggatgaagctggaaaccgtcatcctcagcaaactaacataggaacagaaaaccaaacactgcatgttcttatttataagtgggagctgaacaatgagaacacatggacacaggaaggggaacatcacacaccagggcctgttgtaggggtggggtccaaagggagggagagcattaggacaaatacctaatgcatgcagggcttaaaacctagatgacgggttgatgggtgcagcaaaccaccatggcacgtgtatacctatgtaacaaacctgcatgttctgcacatgtatccagaacttaaagtaagattctttaaaaaggcattcaaacagaaagagaggaagtcaaactatctctgtaagaaaaaaaatcagtggttggcaggagtttgaggggaggaggaagttttggaggaatgcagcagaggggatacttagggcagtaaagcaattctgtatgattctgtaatggtgaatacgtgacattacgtatttgacaaaattcaaaaggtgaatctcaaactatagatttgagttagtgataatgtaccaataatgggtcaccaattgtaataaatatactacaccagtgcaagatgttaataataggggaaacagagggagtatatgagagccctctgttctttctgctctatttttctgtaaacctaaaactaccctaagaaataaaattgattaattgcaaagaaccatcctaggtgtccaggtatggagggaagcagtacagagctgaaaagtttctgttccataacagagacaaatggaatagtagactatgaaatcttggctaaagtccgcactgacacatctaaatgaacacagaacaatttggtcatgtatctaaatacttaggaatattcacatacaggcatcatgtagtcatggtcttccatgatctactgtatgtatctaaacaacagctccagaacaatatgaaaatggaaaaagcaaactaaaagagaaacttacaacatagttgtcattctatggttatcaagacccttataaatgttccctttcaatctatacaaagaaatggaactctttaggctcttattattcttctgtagcgtgggtttttgtgacaagtcctggcatgcctaggacctggagcaaacaagttgatatgacaataaaaatacaaaagaacacagtagacaaacaccactgggtcgatcttaaatgcacaattgaaaattatggaacataacagtctaaattctacacataggcatgaagttcaaggtacttcatcataagtattattatatatgacctttgttaagttagatccatggagatgagacgactttcaggaggcttaagagatccctcaaaaaaccattcttttcatgagagaaaagatgaaacaactccctagtaatcagggaaataaaaactaaagcaagaagatatatttcacacccatctatttggcaaaatattaaagtctaacagtatcaggtgtgttgcttataatgtgaacaagcagtgctgctggaagcataaactagcataactgttttggagaccaatctgacaatgcctattagagttgcttaaagtggaagtttagatagttcctttcagatgtttcttcttttctaaattagcactgaattcaaaaattttcttcataagtcttgttttagctgcactccacaaattttgtcatactgtgtttttattttcatttaatttaaaacattttctaacttctcttgaaatttgttttttgacccatgggttttttaggaatgtgtggttggatatttatatattgacaccatcaagaaagtggaaagacagcccacataatgggacgagatatttgcaaatcatatatctgataagggacttgtatctagaacatataaagcactcttacaactcaagaataaaaatataaataaccctattataaaggggcacagggtctaaacaagtatttctccagataagatatccaaatggccaataagtatatgaaaagatgttcaacatcactagtcatcagagaaatagaagtcaaaaccacaatgagatatcacttcacatccactaaaatggctagaataaaaaagtcagataacagcacgtgttggggaatatgcagagaaatcagaacccctatacactgttagtgggaatggaagatggtgcaaccactttggaacaccttctgacagttcctaaaaaaataaacacagttataaaatggtccagttaattcccaagaaaaatgagaacatatgcccacacagaaacctgtatacaaatttttataccagcattatttatcatagtcaaaaagtggaaacaacccaaattaccatcaatagatgagtggataagcaaaatgtggtgtatctatattatggaatgttattcagacacaaaaaatgaagtatagatatatgctgcaacatgaaatagccttgaaaacactacactaagtaaaagaatccagtcacaaaagactacataccatatggtttcattcttatggaagtccacaataaggaaatctacaaacagaaaatgaattagtgattgctctgagtggggtggagagatgaaagcgtgataactaaaggatacaggggtgatggttgcacatatctgtgaatacactgtgctaaaaaccatcaaattgtacattttaaatgagtgaattgtatggcttgtgaattatattttttaaaagctgttaaaaacatgtactgagaatttttcagatatctattttttttacagccctgttatattttttaactttattatttaaattatcatacagtaaacttagcttttttcttttagtgttaactatttgttattgatggcttgtttggttgcttggtgattagagaacatcctttgcattatttaaaactctgttaaatttatggaggcttttttacagtccagaatatggtctttcttagagaatgttctgtgtgcacctgaaaataatgtatattctgctctcattgggtataatgtccgataaaagtcaattagatcaatttggttgatactgtaatttaattattctttatccgaactgatttactttctatttgttccatcaataaatgagagaggaatgtcgaaatccctaactataattttagacttgactatttttccttacagttctatcagtttttgctttacatctttgaagctctgctattaggtccagacacatttagggctattatgtccttttgatgaaccgattgttttatcattatgaactatttctctttatccctagtaatattcattgtaccaaaatctactttgcctgatattaatatagccactccagctttgttttcattagtatttgcttgctatatcttttcccatccattttaagctatgtgtatatttatatctaaaatgggtttattatagacaacatatagttgggtcttgccttttcaccaaactgacaatctttatcttttaattggattcagatctttaatttaattgttcaggtttttacatttaattaaattattcattttattggacctaagtctacaaccttgctatctaatttctatttacccaatctggtcttcttccttgctctctctttccaggacttctgttttaattgtttttattattcccttttatatccagtattggcttcataggctctcttttttatttttatttcttgctccacaatttacattaaaatgtttaccttagcacaatctaccttcaagcattaaaatgtttaccttagcacaatctaccttcaagcattaaaatgtttaccttagcacaatctaccttcaagcaatattataccacttcatgtataggaatttacaacattatacttccatttccccttctgtcctttatgttattgttgtcatacattttatttctacatttataaaatgtagaaacatattacatcacaatacagtgttattatttttcatttagacaattttcatttaatgggaatatacaaataattttaaaatatctttaaatatactcacatgtttaccagtctcaggactcaaacttttgtttgatccaaattttcatttattacccttttcattttgtctgaagaacttcctttagtattgtagtgcattatctgttcatgatgattctctcagtttttgtcggaaaagtatttatttcctcttcatttttgaaaatgatttcattgggtttagatttctgatgacagttttttccttcagtacatttatgatgtcactacattgtcttctagcttgcatggtttctggcaagaagtctgatgtaattcttatctttattactcattgcaccatgtctcttttcctctggttgcttttaacatttttctttatccacaattatttttcaataatttgatcatgatgtgtcataatgtagttttctttacatttattttgttggagtttggtgagattattggataaaagaatatttagttttcataaaatttaaacatttcccagccttacttttcaaatatttttctgccctctccccctcctgctgctccaattatgcatgctagatccctttatgttgccccacgtcactcatgttatgttcttttttttcagtcttttctgtctgttcatcattttgagtaatttttattgctatgacttcaagttgactaatctgctgcagtttctacactgttaatctcatccagtacatttttcatttcatatattgtatctgtcatctctactagtttgattttggcttttttatatcttccatttttctcttagccatatccatgttttctccaccttcataatcatatagagcatatttataaaagctgttttaactttcttgtctgctaatgccatcatctctgtcatttcaaagtctatttttattgattgtcatctatcctggttaagaatcatattccacaggtttttttttttgcatggccaataatgttttcttgggtgctgtacaaagtggattttacacagttgggtggtggattttgttgcattcctttaaatattggtgggttttgttctgggatgcagtcaacttatatggtatctgattctttcaaggcttacttttaagctttgttcaaggcaggtccatagcagcctttagtctacaaataactaagccctactactaagacaatatcctttggaacattgtagttcctactccaggtattacaggtctattcccagacctgtgtgagccctgttaatttttcagtctattgttttctcatggtctatcactgcccaagggtagatttttttttcctcatacatgagctgcaggtcagaattcagccaaagactagaggggaccctctgcacatctctggagctttctctatacaaatcttgctccctgcaatttccagccttcgtggtctccctggactctaatctttgtctgccttactgatcaagagctctaggattggttttggtcctctctttctctgctgcagcctagaaaattactccaggcaataagctacgaaaatcatagggctcaccttacttgtattctctctgtcaggaatcaccatcttgtacttttgtactgcctgttgtccaatgtctaaaagccattatttcatattttctctctggttttctagttgtttaagatggaaggtaattagtccctgatattctatcatggatggaagagaaagtctcctattatattactttttaaatattcttccaagcacaaaatgtttaatactttaaaaatatacttttaaaaagcatttttattcctcacaatatttggttttgctaccatacatctgagcatcaagaaaataatgctctagaccagagcttctcaacctcagcactactgacattttggacaggaaaattctttgctgtgggaggctgtactatgcactgtaggatgcttggcagttatgacaaccaaaaatatctccacttattgctaaatttaccctgagagatcaggcaaaattgcccttggttgaaaaccaaactttcaatattgtagcaacccagaaacacacccccttttaaataaaagttaggcagccttaaaaaaaaaataacaggggcatattgaaaggacacaggagccaacctgagaaagttcccaatggtcaaaattgcagcaatttgagcaacgagcaataaatattgagagtattagattatacgttaaagcataaaataaaatttatgaattcattctgatataaataatcgaatgaataagtgaatgagagagaaaaattccaattaaatagatgtaggagggatgaaggaagcaatatcaccattagaacaccacagtgataaatgccacaggaggaatctatcaatggatgtgataatgagtgagcaaaagcttaagcagaataggatgtttgcgtattctcaaagtatttttcctaaaatatttagtaattaacaaggtggggaagagggaattataagttgctggtagggaatcctggtagaaatcactttagccaggtgattaaggttaacatacccagtaatacatatgaatatcatgtatcccctgatacaacagagtgagaaaggcacatcacctctgtggtggccttcccaataatgtataacttcaatctaatcacgagaaaaaaatcagaccaaatcaaatttgaggcacattctacaaaataactgatgggtgctgttttgatcaagtatcatagactggaggatacttaaggagatatgatgactaaatgcaaagggatatgctggattggatctaaaatggaaaaaagacatcagtggaaaaactggtaaaatctaaataaagtctatagtttagttaatagtattgtaccaaggttaatttcttaattttgagaactgtaccatggttatgcagaggttgacatcgggtaagctggcttatgggtgtgctgcagttagttctctgcagtgtttttgcaactttttcgaaaacctaaaattatctcaaaataaaaaggttttaaaaatttgagcatcgagtagtgattctcccagcatgcagcttgagatctgagaatggacagactgcctcctcaagtgggtccctgacccctgagtagcctaactgggaggcaccccccagtaggggtggactgacaccccacacggccgggtactcctctgagacaaaacttccagagcaacgatcaggcagcaacatttgctgttcaccaatatccgctgttctgcagcctctgctgctgatacccaggcaaacagggtctggagtggacctccagcaaactccaacagacctgcagctgagggtcctgactgttggaaggaaaactaacaaacagaaaggacatccacaccaaaaccccatctgtaggtcaccgtcatcaaagaccaaaggtagataaaaccacaaagatggggaaaaaacagagcagaaaaactgaaaattctgaaaatcagagcgcctctcctcctccaaaggaacgcagctcatcaccagcaatggaacaaagctggacggagaatgactttgacgagttgagagaagaaggcttcagatgatcaaactactccgagctaaaggaggaagttcgaacccatggcaaagaagttaaaaaccttgaaaaaagattagacgaatagctaactagaataaccaatgcagagaagtccttaaaggacctgatggagctgaaaaccacggcacgagaactacgtgacaaatgcacaagccgcagtagctgatttgatcaactggaagaaagggtatcagtgatggaagatcaaatgaatgaaatgaagcgagaagagaagtttagagaaaaaagaataaaaagaaatgaacaaagcctccaagaaatatgggactgtgaaaagacgaaatctacgtctgattggtgtatctgaaagtgacggggagaatggaaccaagttggaaaacactctgcaggatattatccaggagaacttccctaatctagcaaggcaggccaacattcagattcaggaaataaagagaacaccacaaagatactcctcgagaagagcaactccgagacacacaattgtcagattcaccaaagttgaaatgaaggaaaaaacgttaagggcagccagagagaaaggtcgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagataagcaaatgctgagagattctgtcaccaccaggcctgacctaaaagagctcctgaagatagcactaaacatggaaaggaacaacaggtaccagccactgcaaaaatatgccaaattgtaaagaccattgaggctaggaagaaactgcatcaactaatgagcaaaataaccagctaacatcataacgacaagatcaaattcacacataacaatattaaccttaaatgtaaatgggctaaatgctccaattaaaagacacagactggcaaattggataaagagtcaagacccatcagtgtgctgtattcaggaaacccatctcacatgcagagacacacataggctcaaaataaagggatggaggaagatctaccaagcaaatgggaaaaaaaaaagccaggggttgcaatcctagtctcggataaaacagactttaaaccaacaaacatcaaaagagacaaagaaggccattacataatggtaaagggatcaactcaaaaagaagagctaactatcctaaatatatatgcacccaatacaggagcacccaaattcataaaacaagtctttagagacctacaacgagacttagactcccacacaataataatgggagactttaacaccccactgtcaacattagacagatcaatgagacagaaagttaacaaggatacccaggaattgaactcagttctgcagcaagcggacctaatagacatctacagaactctccaccccaaatcaacagaatatacattcttttcagcaccacaccacacctattccaaaattgaccacatagttggaagtaaagcactcctcagcaaatgtaaaagaacagaaattataacaaactgtctctcagaccacggtgcaatcaaactagaactcaggattaagaaattcactcaaaaccgctcaactacatggaaactgaacaacctgctcctgaatgacgactaggtacataacgaaatgaaggcagaaataaagatgttctttgaaaccaaagagaacaaaggcacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggaaatagagacacaaaaaacccttcaagaaatcaatgaatccaggagctggttttttgaaaagatcaacaaaattgatagaccgctagcaagactaataaagaagaaaagagagaagaatcaaatagacacaataaaaaatgataaaggggatatcaccaccaatcccacagaaatacaaactaccatcagagaatactataaacacctctatgtgaataaactagaaaatctagaataaatggataaattcctcgacacatacaccctcccaagactaaaccaggaagaagttgaatccctgaatagaccaataacaggctctgaaattgaggcaataattaacagcttaccaaccaaaaaaagtccaggaccagatggattcacagccgaattctaccacaggtacaaggagaagctggtaccattccttctgaaactattccaatcaatagaaaaagagggaatcctccctaactcattttatgaggccagcatcatcctgataccaaagcctggcagagacacaaccaaaaaagagaattttagaccaatatccctaatgaacatcaatgcaaaaatcctcaataaaatactggcaaaccaaatccagcagcacatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaaaaggccttcgataaaattcaacaacccttcatgctaaaaactctcaataaattaggtattgatgggacgtatctcaaaataataagagctatctatgacaaacccacagccaatatcatactgaatgggcaaaaactagaagcattccctttgaaaactggcacaaagacagggttgccctctctcaccactcctattcaacatagtgttggaagttctggccagggcaatcaggcaggagaaggaaataaagggtattcaattaggaaaagaggaagtcaaattgtccctgtttgcagatggcatgattgtatatttggaaaactccatcatctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaaaggaagaacattccatgctcatgggtaggaagaatcaatatcgtgaaaatggccatagtgtccaaggtaatttatagattcaatgccatccccataaagctaccaatgacttccttcacagaattggaaaaaactactttaaagttcatatggaacccaaaaagagcccacattgccaagtcaatcctaagccaaaataacaaagctggaggcatcatgctacctgacttcaaactatactacaaggctacagtaaccaaaacagcatggtactggtaccaaaacagagatatagaccaattgaacagaacagagccctcagaaataatgccacatatctacaactatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaagccaaaattgacaaatgggatctaattaaactaaagagcttctgcacagcaaaagtgaacaggcaacctacagaatgggagaaaatttttgcaacctactcatctgacaaagggctaatatccagaatctacaatgaactcaaacaaatttgcaagaaaaaaacaaataaccccatcaacaagtgggcaaaagatatgaacagacacttctcaaaagaagatatttatgcagccaaaagacacatgaaaaaatgctcatcatcactggccatcagagaaatgcaaaccaaaaccacaatgagataccatctcacaccagttagaatggcgatcattaaaaagtcaggaaacaacaggtgctggagaggatgtggagaaacagcaacacttttacactgttggtgggactgtaaactagttcaaccattgtggaagtcagtgtggcgattcctcaaggatctagaagtagaaataccatttggcccagccatcccattactgggtatatacccaatggattataaatcatgctgctataaagacacacgcacacgtatgtttattgcggcactattcacaatagcaaagacttggaaccaacccaaatgtccaacaatgatagactggattaagaaaatgtggcacatatacaccatggaatactatgcagccataaaaaggatgagttcatgtcctttgtagggacatggatgaagctggaaaccatcattttcagcaaactatggcaaggacaaaaaaaccaaacaccacatgttctcactcataggtgggaattgaacaatgagaacacatggacacaggaaggggaacatcacgctctggggactgttgtggggtggggggacaggggagggatagcattaggagatatacctaatgttaaatgatgagttaatgggtgcagctcaccaacatggcacatgtatacatatgtaacaaacctgcacgttgtgcacatgtaccctaaaacttaaagtataataaaaaaaaatttgaggatcttgtagtttcaactgtaggtatacatctgtgattgtaacaaatctcattagactaaacattggaatcacagaatctccaagttggaagcgcccctgtagattatctcattcaattctttcagttgaccttttgagcaaacttgggctagggaggaaacaggatctgcccagatcgatgcaaatagtggtagagaagggactggaatcccttttctgcctcccagggggaagctcttgctatatcttcctgatggtctttcaccttcacctctaaaacacctgcaaacccattctgagatgttttgggtacgttatgctggacatctgttctctacagcaggggtgggcaaacattttctgtaaagagccagatagtaaatattttagtgtttgggagacatacgttctctctatccaatgtagtgactactcaactctgctgtcgtagcacgaaagcaaacacaaaagccaagtagtgacatctattcaattctgctgtcacagcacaaaaacattcatagaaatatgtaaacaaatggatgtttattgtgtgccaataaaaccgtacaaaaacaggcagtggatttcacctgtgggccaaagtttgctgatccccgctctagatctttactagtgaaaaaaaagagttctgagctggactcggtggtacctgcctgtaatcccagctactcagaaggcggaggcgggaggaccactttagcccaggagtttgacaccagcctgagtaacacagtgagacaccatatcaaaaaagagaaaacggggcaatctttggtagctcagtgacagtcacctaaaatgtatctcatgtagtacagttaatagaaaatatgtgcatgttcccagctggacaatagtaatggagaggaggttataatggtgagatcttctaaaataaagaaacagtagagatagcaatatggtctctttgtcctttgtgttaggttggcctaagcagaggttgatgaagtagtataaagaatgtcaaagacaataagcccataaatggaaagatgaatagtcatctctctgacatttcattttgcccttctcgtaaggaggggaggaggttttctatagaaacatccagagctgcagagctttcaggtttcaaagacaatgaattaaatctaatttcaaaatagttggtcattatgctaatgcacatgcacgcacacacacaggggcaaagtgttgtgatctaaaatacttagaaaaaatgacagaataataataattctgttaggagagtatgatttattataactgtttagtatcgacagaaagcaggcatgaacaagcagcgtgaaaggaggagaatgaatattttaaaaatataatgtttaatgatatttccaaagaaaatgtttctgagttgaactcttttcttctttcaaaaaatttattctatttaataatggttattacccatttttaaggtgccctgtgatgaaaacaatcttttgagacgaagtaaaacttcagtaggaaatgaaaacttcctctcatttttctcatatatctgtaatgcttacccacaaagtaaaacagacaatacaaatgctaaatataatgagcatgtgcttaaataatatctactcctgacagtttcttgatgttgacataatgtttccatgggtctgattagcttgttgcttctcaggttaaatagttcatacacaagttttctttccttctccatttgaccacaaccttacagggagacatatcgtttggagacacattttttgttccatcatgaatcctgaggtgtgtggctaagctagtaagagcaatgcaggtgcagtctgtccagggtccagctagcagccccaaccatactatacccatgagtcccggggtcacttcactgttccttggagggccaccagagtaaatgacaagagggcaggaaaggagttagcaaggaatcaaagttatattaaccaggaataacaggtttcctgggataggtctgcttctaatagttgacctaattgaccaggccttaaatacatttgtccttggcagaacaccgatctagaattttaacttcagagctaggagactttcagatccagcgataagaagagaatgaacagagagcaaatgggaagaaaatggtgcaaggccttcacaatcttggtcaccttcccctatttggtatgtgtgctcttccctccctgcccattaggcgctgattggcaatgaagtccccgaaaatgaaagtatggacaatcaggaagtgaaacctaggaggagagtagccggagcaaaggagggagacaagtgcctgtgagacctgtgaggagagaggagctaagctgaaggaaggcagcacagcatccttgagagaacacccattttggggtcagatactcatgttgaaattgtaattcttctatctgctggatgtgtgatcctgtctggggtgggcagggggacatgtcattgagtttctctgaaccttcaatttcttgtctaacaaatggatatctaacacgcaccttgccattctggatatgaggattcaatgagagaatgcatggaaagagcccctcaaagttctggcacagagtaagcccttgtgttaggaatctactcttggagcttatgggaaaagggatcctgggtagccagcccaagagaggaaatagccccaaaatttagctttcaggaaactcagtggctttctagtcacctcagccagctgcctccattccaccacaaaaccaacagcttcaaaaacaggccctgtaggaggtggtcaaacagctttccctagtcagtgccttctgagtgaatactgtcatgtagttcactggatactttgaggaaagtagccacaaggcaaaagaattctccagtgagctcccccaaaatctatggcatcagcttagcatcacagcatactgcttaattaaggtgactctttttctcatctctctttccaccttaacttagtatctttcagttagctgtcaaaaggctgtgctctttgcaacagctgctgctcccctggctgccagggctggaacgttgaggtcgcctggcaatttcgtaattctgatcctaagttgaggacagcatcatagcaacacttgagtgtcagggcagaatatccagtgtaaacacttcatcctgagttggcttctgtggcttgttcagcacattttggatttattaccctctctagcttccgtgacctcgaggaatgaaaagccattttaatagtagtgtaagtaaagctaatttaagaagggaaatctgctatatatatcaaataatgtctttcaaactgaaacgagtgactttggggtgactcattgccttggattatccttttgaattattcatgcttcttttatttcctcctttaacacaactgaaagctggcatcatcatcccacctcaattctggggaggggatagagatgataaggattctatttactaatattcgtaatgggtagtttgaaaataaaggagaaattaaaaaaaaacagctgcattgagacagtgcctactttcacagagctcaacacgtgttggcatcatctatttgatggcatctatcctcaaggtcaatttgtaagtatgaattgagtgtctaccatatgtgaaagagaacattccatgctgtaagcacagaagcctaagtaataatagatgtgatgttgtcatctgagtaagaagagatcaggaaatggagagggaacctgaatttctgagtacctcctgctttgtataaaaatgaagaaacttaaagtgggtagatattaagtagttttaccatggtcatacaggcagcatgagatagggccaggattcaatcccagtttctctgactccaaagactgtgatcttttcactataccatgttggtatctaaaaatataggtcttcagatctggggcaggaaatttacataatgatcccagaatatcttatcatgcctagcaaggaagctttcaaaaaccacaagattcatgtaaaaaggactcaggggccaatttaaagaggttccctatggccaaagaggggccaatgtgagcctcaatataagaacaatcaatcaaaacacataaaatatgtttaaatccatgaattcattattatattttgaaaataatcactcattgattatattagtggatagtgagctagctcattatttggaattaggcatttatcctgccttcttatataaactgtaccactggataaccaagtaggagatgtacagaaatattccagctaacaaataaagaaggaataacaaaataagaacatcaccatttttgcaacccttaatgaatgaatgaatctaggtttaattgtcagtggctgctagcatcacaaaaacagagacaaccagatagtgcgtgcctctaaatgtagagcacaaactgtatatgaaatagtcgaccaaaaacaaaacaaaaagcaaagaaacttaagcctctaaaaccaactattaattcagagaaaacacagaagactgcagagaatgttaaacttaacaacaaaaatgcaataagtaaaatccagtataggaaatgctacatgtaaaagtactcattttcttcaaaaaataaatggcaaaaagaaagaaggaggggaacctgtagattaaaagaaacttaaaggccatatcaattatagtatctagcccatatttggagttttattcaaacaaatgaatatccatttatgacaactgtaagagagttggaaactttaacattgacgggatatttgtagattttaacacagttttgttcatttttagatgtaatttttgtattgtggatatgtttttaaaagaatcttaatcctttagaaatacatactgaattatttacagatcaagtgttatgatgtctgtgaatggcttcatgagattacaaaaagaggtaaagcagatgtgggtacagatgaaacaagagtggctgggtgttgatcattgttgaggctggatgatgggtataggggactcatatagttctatctgcttttgtatatatttgaaatttttcataattaaaaagatgtatctatacaacacacacgtacatgatttgacgatacatgcatgcatatatatgccaaaattcctcttcttggaattgatcctgtggatacagagtggaaccataccatatgcatatgtgagttatgtaaattcaaatatatacactcggtatacagaggagagaggcagggagacagagacagaaagttagagagaggagagagttgagggaaagacaagacaacaattgaaatggcgtagcaggttgtgcccaccattccgctcaatgatcctgctgtgccctagagagaacataaggtaaaagctgtggttcttctactccatcggtaaggttcagtccctgtgtgtctctcatacagtgagcatctcacagtgattgtggtgtttaaagacacacatatttcattcaacatagctcataaccacaagctaacctcttcatctggtgcttagccaatgactcagtgatctactccaatattgggggcaaataggctctgctggaataatgaagatatggcatgtcagccttcctgaggaagtttttttgtttgtttttgttttgtttgtttgtttgagacggagtcttgctctgtcgcccaggctagagtgcagtggcgtgacctcggctcactgcaagctccgcctcctgggttcacaccattctcctgcctcagcctcccgagtagctgggactagaggtgcccaccaccacgcccggctagtttttttttgttttgtttttttgtttttgtttttgtttttttgtatttttagtagagacagggtttcaccatgttggccaggatggtctcgatctcctgacctcgtgatccgcccacctcggcctcctaaagtgctgggattacgggcgtgagccaccacacccagcctcctgaggaagttttaagggtggttttgactctatgggatatttacgttatgtgctaaagaatctagccaaagggtgttaaagtccatcatacctatacatgtgtgcaaggacatgtgtcaaaagatatgtttaatgtttaatatgtcactgtaatatttaaaaactggaaaaatcctaaatgttcactaacagagaactggttaaacatggtgtgttttcacagtagaataatttatggagtcattacaaagaataaggttgatagcttccacgcaataataggaaaagatgtctaagacatactgttacatgaaaaaaagcatgtggtagaataacatatgtagtgagtttatatttttgtaaattacaaaaagaataaatatatacctgtagagacatacacatcattgttcttttacagcacatttctaaaagaatatactagaaactagtagtaatgatagactgaagagaggaaataggactttagagtgagaggataacttccttttaattgcacactctttaatatagtttgaaattttaacatgtgcatgcatcactattgacacttttgttgaagcattacacacatatagaaaggggcacagtccatatctgtacagttcaatgagttagcataaagtgaatacacacaagtaaccactacccagacccaaaacagaacattgccagtctccaaaagccccatcatgcacctataattctcctttctttccccttggaaattaactactatcctgatttctaataccacagtttagtttaatctgtttttttaaaatctttatagaaattgaatcagacagtatgtattatttagggtctgacttatttcaatcagtatgtttgcagagcctttcacattcttgcatgtaggtatactttgttcattttcattactgtagcgtagtctattgtgtaaatgtattgcaatttatttatatatttactgttgatgaacattttggttattttcattaattgaccagtactaaattaatgctctaatggacattcttgcatatgtcttttgctgaacacaggcagtgaaatttctgggtcatagggtaggtatttgcttagctttagtagatactgctaaacagctttcgaaagtggttgtgtcagcttacccttcaattagctgtggatatacacaataacaagaatgaaaacaaaatcctacttcagttcacataagcagtgttgatttgactggtatttctgtgttgtttgtaaaaattaaagacatgaatcactatgttacctaatgtgtttattcaatattcctgtgacaaatccctatttgagttttgtgtcaggaagaagttgacatttaaagaggaatatagccctcttctggttctcaagttatttatgccactgtaaccctcacccttgactgcaaaaaattcagttaaagtcagtgctcaacatgcatagtgttctgatcatgaggtatctggtaatatctactccttcttgaaacatgcaactcttctctatgtcttactttacatgatacttaaactggtaagtttctgcaaatccttttggaaataaagggaggaggaggttaaattgtaaataaataaaccaaaaatagttctagccccagatggtgaaatttaaaaaggaattgtaagaaactaaggctaatacagtccaaacaacaaaagtgcacaaagaaagcagtataaaatgcagtgttcagtaatgtgtgatttgccaaccaccatgcacatggctggtggccaggacaatgtcaggtttacatgagtttcaagccctcacagaacatactgccacattttgtcttgatgggcgaaaggtagaaactcccaggattggggaccttgtgactccggcccagtggatgagcccctttccccagacaagggtccaatttattcttcttgaactggaaagaaattatcctttgtaagagacacacagtctactactatgtctctcagtcaagtattgccaccctggaatatcttcctatctgtgcgtccaggcagacagatgcccacatacttcttgctcactaccagaaggagccctaagcaatcaaagggcccacttgcctcacctttggatgctgttgtggtgttcatctaatacttgatgaatgtatcaatagatttcttagatctcacagtagtgaacagatagattcaataagattttccatttgcctaggggctaagtctttgctgagtttgaaactgatatcacacagagtaagagttcaggggagaatgcctgggattctggaagagtatatgaggctctagaatttaattggaggtttaaagaacaggtaaggtataaaggcaataattaacatgaattttgggaaatcacatatgctgagtaatgtatctacagaccaaagcagagggaataagtattgggaaaggagatttggattagttcatggaggcccttctattccaaattaaggaacttggattgtatgttattattgaagatttttgagtagggtgagaagagatcatagtgaaaataatatttcaggagatgaatatggccatggtattcagcacatactgggattggggagaaagataagcagggatttcactgctactgctatgattcaggcaaagacaacacatgtgaaattggttgagtgcagcacggatggaaaagcagaaacagagaagaggacaaaggaagaactgctgggttctgaagtgatcacgtgtgcaaaaggaggcagaaggcaaagcaggcttggagccaggagaaccaggagacaggcacctcaattactgatggtagcattctttgtaatagcaaaagattagaaccaacccaaatatctgtcaacagggactccctggttgaacaagctatgatttctcttcaggctggcataggatgcagttataaaaaaggaatgaggaagagctccatacgatgacatatgataatctgtaggacatgttgttaagtggaaaaaacaaagaagcagggcagtgtttatagcacatgatacattttgtgtaagaaatatgggtggaatacaactactaactctcatttgtttaatattcaaacacataatagatctataaaacaaaacctaataaaaatgattgctaaaaagggaagaaggaaaaagaatggtgagcagaatggaaacaagacttcaagaatatcttctcttacatgattccaactttggaacgtataatcaatgtaaagataaatccaaaagagaaaggaaaacaatccctaaaactgagggaaaaaatgaagcaaaggaattaaactgcgtatcaagttggaaacataactccacagggaaagaaattagttcaaccgacattaaaatataatactttgactacctccctaacaggactttactttaagaacaacaaaatagcaaagcaatcttaaactgcattccatagtcttagtagtaacacttgaattgttattttaaaattgttacaaatatcaggtagggtaaagcaagtaattttgttgatgtcattaggaaccaagacttttagagtaagagagaagagatacagttacaaacataaaagataagtaaaaaccctatcctcttaaatttgactttgaaatatcagtataaactcatcacttctattgtttaaaaaatatgtatctcccagctctttcactaaaaagaaaatacatgacaatctagtagctatgaggaaacccagctctcagactgtgctctctaaatatcatttcccattaaggggagttagagctctttggataaatggttgacccccagtttgggtttggaattgtataagatgagcctgaaacatcctatataaccaaaaatcaaggaagctatcatgacaaaaggaaacagaagccaacttaaaagatttaacttaaaagttattatatataactatagttataatatgtaactatatattatatatattatattatatataactagttatataatatattataactagttatatatattatattatataactagttataatatattatatagttataatatatattatagttataatatataactatatatataactatatataatatatataactactctgccattatcacatcaataatatatatcacaactagtactactagttgtgatatatatataaaatgactctgccattatcacaattaataattcattatatataataattcatatatatattccttgtgaattgtataaggaaaatatatataggcattatcgctatatgagaagatagaagaactgaaaaactgaaaggtattactgctaataaaaagagagaagatgggaagagaagtcagtttggggaaaaaaagatgaggattttgagacatgaagtttgggaagtcagccaaaggaccaggtttaaatatgcagcaggaggctgaagactcagacttggagctcagaagaaatgtcagaactggagagagatttgggagtcatctatacagatgcctctaaagagcaaagccttgggattagattaattttcaccagaaaaggagagggcagggccaggtccaagccctagagaatatttatatcacactggggtgctagcggtggtagggaggaaatggaagaggtaatggtgaggaagcaggaggaaaaaaaagacttggctgggtgcagtggttcatgcctgtattcccagcactttcagaggctgacatgggtggattacttaagcccaggagttcgagatcagcctgggcaccgtggctgaaaccccgtctctataaaaaatacaaaaattagccagacatggtggcacatgcttgtagttccagctaatcaggaggttgaggtgggagaatcacctgagcccagcaagttaaggctgtagtgagctgtgatcgtgccactgcactacaacctggatgagaggagtgagaccccgtcttaaaaaaaaaaaaaaaagagtcagaaaaacacaaggaaacccaaaatagttttgtcttacagaggccaaagagggaaataatgccaaggaaagagtggtcaacagtgttaaattctacaaggttaaggaggataaggcctcagaaaatgcaactatctcttaccccaaattcctaccatatatccaaattaatttgaagctgatggtgacctcactaacagtgagcctgtaagacactgtcttaatcatcagcttccatctgttccttcattcattccttccctcaatcccccactccccagtcattcatttaaccaacattcactgagtgtctactccaagccaaacccctgctatgttctgcagatattgagacaaatgaaatatcgtccctccagaagctcacagcttaatgaggaagacaggcctggaaaaataattacagcatagtgttaacacttcagcaacgacttattgaatgtatattctggagcagacactatgggaggcactagagatacaaacataaacaagtagttgtgcctgctgggagctcagaatatagcttggaaggcagatagaattataacatgttatgatacgatgtagaaataaaaggaacatacaaattatatgacagcacagagtaggaaatgaggcttatgagtaagtcctgtgaggtaagggatattcatatgcccattttacatatgaggagattgaggcatggggagatgaggtgatttgctcaaggccatatagctgtgagtggtagagccagggttcaagtgtgggtttgtgagactcaggagttcaggctttacccactctgccatactgcctgaaggcctcttccaagacttcccatgctctttccactgtgccaccctggttgcacctcccagggcacacagtaggtgctcaatgagtgtttgttgaatgaataaatggataaatgaatgaactgtgcaactacatagggttgctgggaaggttctgagataaatacttggttaattagaggtcattgtatagagtcactgtgtaggatggcaggtgaggacaaaaagactccacacccaagtgggaatctctgctgtgtgggccactattaccaaaggagaagtcatatccaacaaatgtgttgggatagctagagactggcatcagggagctctgagagtagagggaagggcgtaagtcacaggggctggaaggggaagcgccaaaggccaggcaatatctcaaccccagagtgctcatgctgggaatgcaagggtccagggcccaaaatctagttacccaaactgggccactaggtcggagccaggtcagcttggtcctgagtccatcaagccattagcctgaggtttgagaaagccctctgaaaatgcgggatggtggggtgaggtgggaaaggagaatgagagggatgatggagaggaggaggggaaaaggagaatagcgaaggccaacatttaccaaatgctgatgtgggccaggtgcttcactaagtgctttccaggctgtcaggttaccctcgtaatatcctatgacagatacttaacttcccaattttcttagctaagcttgccagccaagggcaaggggctctgctctcctcttcatgcacctatgcaagccctgcctgcaggtagcagtggcccctgctgatggctctagaggagacaagtgagcacagcaaagaagtgtgaatcagctccaaatgatactttcccattacagagaaaaggggcttgggtgggaagaagcaaagttccagtctcctcctgtgaactcctgaggttgccaatctccaatctgtaacaatgaagatgctgacaaggtcatgcacagggcttctgccatacagcttagaaagccttttacatacatgacttgattattatgcccccttagtgaaaacaattaaaagacaaaaacaacaataagatggtttttggtcatggagattttccccaaaagattatttttctccacttcaatccatgtatatttcccagatgtcctctggtcttctgcaatttctactaagaatttcagctatcccaacaaggatgttcaaacatcatagtttctactaacatatggagcccatatctcttggctccaaattcatttccctttccaccacatctggcacctatgctgccaaagggataggagaaggaaaatcaggttccacaggagctggggtgttattcttagattttttcccatcagcccccaattcaattcccttttcctactcagatccctacagttggagcttccacctagaggctaaggctcactccagttccctgaccagccaattcacaggcatgaagtcaatgcctggcttcagccctgggctggagcattagaattagggtgctctcccctgtctgggaccccctagaacagctgcctgaaagatctgtaatgctcccagattagaactcttcccaagcctacctcttacactgacccatgcttaacagctggtcttctgccttaactcccactcttaagtcctagagttgtcctgcctaccttcctaccctccttgaaaactaaacgctagcctaaatgagatatcatcttacttaaatcttccttcaacacctggcacagaggatggtcctcaatactagactaatgctggatagatgagtcactctccctgccttgtttttgcccacctttctctctggaactggcaccttgactcagtggctagggtgtggccactggttagaggtcttgcagatgatgattgcccaactggcagaagagccaagtaatacccacatactccctaagctgtgtgattttgaataggttatttaactcctctgtgccttagttacctcctatgtaaagtgaggagataatattgctgcctcacaggattgttgtgaggaccaaaagaattagtgtatgctaaatacttaccagtgtccatacaagtgtcttcttgtgctattgtaattattgttattatgttggttatgctgtattcctcagcactgaccattttctagaatatcaccgaggcacctaggtctgcgtggagagtattcttctcaccttcttgtctgcctttgcctgtaacaatgccactttcccaagcctgggtcctggttagtggccatatccaataccaggggtcagccctctctcctccctgactggcctgcttctgccattgaggccatgatttcaggtgcacgagtccaatgttaggacaaacagccacttctaaaccaaagaccaagtaagcaaaccattctcttttaggctaggaagtaggagaaagcatcatcagtatggtctgagaagcagcagtcttggaggagtgaagcagacatacaaaaagcttggctgtgtctatggcaactaggtgcagttgtacaacctcccaaaggctagaaagcccacttcccttgatgggagggctgccctgggaagtgttggccaacagaacaggggttgctttgtgggggatggggacctgccagtgcagctcctgacacaccaaaagcgaatcccagcatctcagaaactcagcgtcacgttccaaagagagaaaaaatggcctaccaagagcacttgtttattgctcagaaccctggtgtagcccagctctgcatatctgctggctaagagaatgtttgactaagggatgcactcagagctcatttagccaatgagcctttcttctactggtgagaaaactgagggctttttctgccctctgcatggctttttagaggggttgctctaaccacataccataccatgagcttcactcaaaactcgttgcaaacaatgccaagccttggaaactgtaccaaagcactctcaccttcctgtgactcacagtgcttgctttattccgcactcacctgaccagtcatctcagtgactgctgattttggttcctcagtttgggcaatccacttggacttcctctggcttgtagacttgaaaataagtctacaagccagagaaaggcttgaaaaatacctgagggctgtccctcaggtatttttactaccctggctgtgctgcctcagcctgtgtctgtaaagagaatctctccttcagcccaagccagatcagtcccctcatctgcctgccccccaacagattttagatcttgggattcagacactatggcccagaaaaataatgatagtaacacaagctccttgtcagaggtgagatattttgtaaccattaaaataaagaacagaagaatgctggttcaaatctcagctccagctctgcagagctacatgagtctgaacaaattattaaacctctctgaacctcaaatttcctcctccataaaatgaagactaaatgtaatattgtatgtacattcctggaaatagaaagtgatcactaaactgtagttaatattagtagtagtaacagataatctaataacctgtgcttcttcgctatctatcaagctggtgccacagagcaattgttcagtatgtgttgagtgaaaaagatgtttccctattcaacaggcacaaccaccaggtggggcaggtagagaagactttggtctccccagcaatggagacctgagtctgaatggttaaatgacttgtctcaagtcacaattactgagcagcagagcttggattgggaacttctgtttcttgactcactgtttgttgtttactgttttaatttgcctgatcaaatttaggccagagaggaatttagagattatctagcataatctcatcatttcaaggttagaaaacaagccagggaaatcaaggatgtttcccctagagctaaagagctagtcagctggggagtacagcatagatctcctgactccagcttagtgctctgtcaataatgtaacagcttactttgcaaaaatcacctctctgtttgtaattcagcaaacacagtcattctaggtgcagagctgctatagctttctaggaaaacacccaaatggtaactgcaaaggccttctgcaataacaggcccaccttcagtgtaccagattcattcttcatggaaagtgcacctttggtgtgacttgaaggaatgtgtcaacatgaagcctggtgacaaccaagtgtgccaacagccacaagcttcgtggtgtggagtgccatctttgaagcagaccctacaataccgctggtatgtaaagcatgagctatgagaaacagcaccacttggcagttccttctaaagtaataaagacagttaaatgaggcccaaacagcacaggatattattgtttacatgcaacccttatcccatggctgtaggaaatggagccaaattccacaagccctttcattataagagtgctctgcaagacagaggaggccagcattgctgcttggtctgctgttctttcttgaagtcagcttcatttgagaatgaaaaatgttgtccttagaattcaaactccacaaaggcacaatgcagtacagaaagataatgttttaggatagattaataatatttatgagatcttttaaataaattccacttaattgacatgcaccagctcctcctttccaacaaaaattacttctcaaagaattaatatattaagtttttactctgaaatagctcttaaacactctttcttttcattggtttctctgttttccttttttttaaataaaatgcacatttgtattgcacagcttttaagatttcattttcttatagaaatgatttctgaaacagatattagaatttgcataaaaaagcatttaagttgtgaaatatgttatttatgttttccttatatacactttaaattgctttggaaagaaatttttaaaatatatttaaagtgcacctattaacacactaaattggaacttatttttatttgataatactgacgtccacaaaggcacaatgcaatagagaaagatcatattttaggatagattaattatacgtataagatcttttaaataaacttcacttaattgacatgcaccagcttctcctctcctttacaacaaaaattaatgagtttattttccaccatggtctgagtaagataaaagagataaaacagtgactttccttgagtttaatgttgagaaaatataaaatcatatatatccaaaaaaaaaagaattcaaactccaatgttggggaaatgtattaggttgttccacttgcagttaatctgaggatgcaaaagttaaataagcattgtgtttacctcaaatgaaatacataataaggagagggcagaggtaaataactcatttgtcaatgtaactagaaagggatctccaataacttctaatttaaaaggtttcgaattttgaagagtttctgatggaacaggagaggatgtttcctatagaagacaatcaacaccttagattctaataccactctttattccaccttcgaaaaatcatcaaaacacggtgattatccactcctatgctattgcacaatggtggctacagaagcatatgattgatgaaagaggcctgactctatgtccgtggcatgccctggtcaagcacacaaatcaggagtaccttgccctactcccccaagcacaagcaagttaatagcagtgtttgtgggtaaatgccatatctcttggttttctctgcttctattagaaacagccatagccagtcttgggtaagtagtccgtcttaacatgcttgcttgggtcttggcagtagaggagaaaggcctttctgaaagcaccatcttcacggccagtctcccaaaatggtaccatttcacagttggttttactcttactgcattcacttaacatatttactacaggccatgttctgcacttggcattagagatagggagaagaataagaaaggaagcaatcaattttgtcttgtggaggaatgattgggcttgatactatttgagctgctcctggaggacatgaatagtgcttcaacaggcatgggggtggggatggagtattaatgagagagaagatgtaagaaggaaagaagctgtctaatggctcatacacttatttgcttaaacagttcgaatcactggattgtaaatggctgaagctgttttgttgatgtgaatgagtatattcatggaaaacgtgcttgttattaaaatgacgcaatgcctttttgcaaaagaccgcatgtagttaaaagtgctcccacaactatgccagcttctaataaacaggaatttggtgtgtatctaattgggttttaatggctctggcaaaattaagaactagagtaatttgatatggcttttttcattcaaactttctatcatcctaatctccttagaaactataaagtataacttactttcatcagactataagcaaagcccataagcaaaggaaaaaataattaaccagatatttttagttttattagataacaaatattacaaccctggcccaatgtctggtcagtaatgccacagaaaaaaatcgttcattattttgcagcctatcgatgagacattttacaaaaatgaaaattatctcctatgccattagatcttatgtctgtaaagatgtattttacatctgtacccctggtggtaatatgtctatgtcattaactgggtaagaatccaaagctgatgatcaattaattattcttcattgttaccattgttttaaattatcaagggtcttctagggttcaggaatctcacctttttaagttccaatgtcctgaaatgtcctgaaatacatacctacagaattttaggtaatttcatttttttatagatagaagcagttatgccagttcttatcaaaattgcaaaattacaactagtcctctctctagaaccaaaccctggccatgtcacataatccagagatggatatttctaccaaatagctaaaaaatgatgaggaaaccactggaaaaacagaagagcctgtggataggtcaggaatctgagtagggtaaattagggaaaaggcagcctagaaaagaagagggccaagaacaatggacaggagttaaggtaggaaaacaattttttaatgtgcccattttctctacttactaccctgagaacaccattcttttccctgctttgccaccgggagacatttaaacagtagactagtacccactaggtgtgaactcagggctggctgagatgatgggtactagatatcaactgcatgtggattggccagcctttaagagttttttccccacttctacctgtatctcgacaccctgaaaactagagaactacaactacagaggattcttctgaaaaaaagcaatgccaaggctgagttaccatttgttatgctagaggctctctccccagcaacatagctccccaccatcaaacttattgggttgggaggcgcactaggcaaggcttaagttttagtggctccccatagttacacattacaatccaagacagccaaaaccctagtggaacaggagttcacaaggaaaaacggctaatgaatattcactgaaaagcatagtggaacaattgagaatagcagctgaaactggtggaggttgtccactctccagtactaagtgagtataaaaggcctacggcaagaaggactaaagaggctgtaggaatctagccactatgagctctcaaaaatgacttgtcaagattcctttctaggacagaataccacattaaagataagctgctaggagtgaaatcaaaattgagcaggatcattgcttctgcttctgatatgactgaataaactcctactgattgcaatcctcctgaaaacagcaattttaaacactgaacaaaatataaagaaacaatgatatgaagagactggaaagtgaacagaagcagacatattcttaaaaggagttgacatttgaataaaggtatggcataacatgagcaacctatttttacagcttttagactgagggcaagccaaagctgccaagtggctagcacactaagaataaactgacaatcattctgatatgaagaactaaagaacagagcttgggacaaactgagccactggacagttgtggggagaatcctgtaaaggagagagagggcaagatagaaggagcactaattcctgtatatacaaactatccaagtctcagttggcccctgaaccacacatacatgggacagactttagctaaagataaaagcactgaactcacattttagctaccaaccaagagacagaatttagtttcagtctaaccaagttaactgtctgctaaaacaataaaatcagtatttttcagacacagaacccagagtctccataatataatattcagaagactcagaatacaatccaaggttactcaatatatgaagaactaggaaattgtgatccattccaagagataatacaatcaacaaagagaaaacctaagatgattcagatgttagaattagcagacaataaatttaaggcaactagtagaattatgctcaaaggagtaaaagaaagtattttcacaataaatgaaaagatagaaaatcacagcagagaaatataaaccataaaaaatgaaaattacacaattggaaaatacaatatctaactttaaaaaatcactgaataggcttaacagcagaatggaaataaaagagggaagtttcagtaaacttaagatgaaactttcaaaatcatgcgttcctatagatatacagagaacaaagagaaaaacacacgagaaaaaaaatgaacaaagcctcaggaatgtgtgggacaatatccaaaggtgtaacgtacatgaagttagagttctagaaggagaggaggaggaggagaatgggatagaaaaaaattgcatgtgtaatggtttaaatttccctaaatttaaagattccagaggctcagcaaatcccaagaggacagaaaacaaagtcttggaatatagtcaaactgctgaaaaccaaatataatgagaaaatcaaaaaaacagccagaaaataacaacattttacacacagaggaggaaaaatgactcaattactgacatcagaaatgatggaggccaaaagagacaagaccaacatcttcaaagtggtaagaaaaagaagccaacctggacttgggaaagaacaaggtggtggaatataaacctctcctgatggttcatctgcaaggacatgaatttaacaactatctacacaccaaaaaagcaccttcataagaaccaaaatcaggtgagcacacacagcacctggttttaacttcatatttctaaaggaggcactgaagaggtaggaaaaagtcttgaatcaccaaagccacccctccctcatctcccagcagtggcagtgtggttcggagagcattcctgtgtgtcatggagagcaagattgcagcaattgttaggcattgaactcagtgctgccctataacagaaaacaaaaacagaccaaactcagctgaatggagggaacatttaagccagacctagccagaggggaatcagcagtcccagtggtcagaacttgagttcctgctagtctcgcaaccacaggttaaagtgctctgtgtctctaaataaacttgaaaggcagtctaagccaaaacagcagcaactcctgggagaatcctagtgctgaactgggcccagagatagtggactttgaaaggacttgggtgttgtgatctaagctgtatctaagcccctttaaagcagattcagcttagataaaccagaaaactattagaactgttaaacaaattcagtaaagttgcaggacacaatcaaaagcaacacacaaaaatcaatagcatttctatatgccaacagtgaacaatttgaaaaagaaatcaagagagtaatcccatttttaacagccacaaataaaattaaatacctagaaattaacttaaccaaagaagtgaaagatctctataatgaaaagtataaaacactgatgaaagaaattgaggataccaaaaaaatgtaaaggtatttcatgttcattgatttaaagaatcaatattgttaaaatgtctatactggccgggtgcggtggctcacgcctgtaatcccagcacttcaggaggctgaggtgggcagatcatgaggtcaggagatcgagaccatcctggttaacacggtgaaaccctgtctctactaaaaatacaaaaaattagccgggcatggtggcaggcaactgtagtcctagctactcgggaggccgaggcaggagaatggcgtgaacccaggaggcggagcttgcagtgagccgagatcgtgccactgcaatccagcctgggctacagagcaagaccccgtctaaaaaaaataataaataaaataaaataaaatatctatactactcaaagcaacctacgcattcaatgcaattcctataaaaacactaagtagaaaaaaatcttaaaatttatatggaacaacacaagacccagaatagccaaagctatcctaagcaaaaagaacaaaactgaaggaattacattacctgacttcaaattataccacagagcaatagtaaccaaaacagcatggtactgttataaaagcagacacatagaccaatggaacagaatagagaaaccagaaacaagtccacacatctacagtaaactcattttttatgaaggtgccaagaacataaattggtgaaaacacagtcttttcaataaatggtgctgggaaaactggttttatgtacaggagaatgacactagacccctacaaaaatcaaatcaaaatcaaatcacgatatacaaaaattaaatcaaaatggattagagacttaaatctaagacatcaaactataaaatactataagaaaacatccgggaaactctgtaggacattggtctgggcaaaaatttcttgagtaatactccacaagcacaggcaaccaaagcaaaaacggacaaatgggattacatcaagttttaaaagcttctgcacagcaaagaaaacaatcaacaaagtgaagagacaacccccagaatgggagaaaatatctgcaaagtacccgtttgacaagggattaataaccagaatatataagaagcccaaataactctataggaaaatatctattaaactgattaataaacgggcaaaagacctgaataggcatttttcaaataaagacatacaaatggcaaataggcatatgaaaagatgctcaacaccactggtcagcagagaaatgcaaataaaaacttcaatgaggtatcacctcaccccagttaaaatggcttatatccagaagacaggcaatagcaaatactggtgagggtgtagagaaaagggaaccctcgtacactgttgatgggaatataaattagcacaaccactatggcaaacagtttggaggttttcaaaaaactaaaaatacagctaccatattttccagcaatcctactgctgggtatataactaaaagaaagaaaatcagtagatcggcactcccatgtttgttgtagcactgttcacaatagcgaaaatttggaagcaacctaagtgttcatcaacagatgaatggataaagaaaatgtggcacttacacacaatggagtactatgcagccataagaaagaacaagatcttgtcattcgcaacaacgtggatgaaacttgagatcattatgctaaatgaaataagccaggcacagaaagacaaacattacatgttctcacttactagtgtgatctaaaaatcaaaacaatggaactcatagagacaaagagaaaaaggatggttagcagaggctgggaagggtagtaaaagggtgggtgggaagtggggatggttagtgggaacaagaaaatggtttgaaagaatgagtaagacctagtatttgatagcacaggagggtgactataatcaataataaattaactctacatttaaaaataacgaagagtatagctggattgtttgtaacataaatgataaatgcttgaggggatggataccccattctacatgatgtgattattacacattgcatgctcatctcaaaacatcttatgtaccccataaatatatacacctactctgtacctacaaaaattaaaatattttttaaagtcaacccagaattctatgctcagcaaaaatatgtttttaagaatgaaggcaaaacaaagatactttgagatacaacaaaattctaaaaaatattgttattaatcccttgtcagatggatagtttgcaaatattttctcccattgtatgggttgtctcttcactttgttgactgtttcctttgccctggtgtggttattatgcattgtatgcctgtatcaaactggcctatgcaccccataaatatatacaactactatataaccacaaaaatttaaaattaaaaacataaaatcgtgaaattgttaaagaataaggaaagaaaaaattctttgccagcaaacctgaaccacaagaaatgctaaagttgtaggagaacagctctaccgcatggtgccccaatgatcattttagtctccatatgggccacttaggcaaggttttaccataatctgacctgggtctttggagaacaccatgcaattcctcttggagcaagggaatataaacagcctggtgaggaaccatcccaaggctgtttttcatccgtctccctaatgtcggtgagcacagaactttccaccttgtctcactcccttatgacacagctgtataaacatgtttggctatagtttagagctggtttttcagtgtcagagtaacctgttattcatgtcatctggttcctctggttcagtgtaatcctgttggactatggatacaggcagctaatgccatgttgatcttgctgttactctctaagtaataaactgaatctatctgggcttgtttttccttactggctgaatctatgaaaatgtgacaagctgacctagcagctagacaagtgatcctattagcttcactaagcaattagcttcatctaagccaatgctgcctggatactgcttgacttcttgacaaaaggaagttcttcaccaggctgaaggaagatgaatccagatggaaatgcatacattaatttaaaaaataaagcagaaattagaaatatctgggtaaatatttaaaaagccatttcattcctcttaatttcttcaaatacataggattccttagaccaaaaattatggcatttacttgtaggcttcatatgtagatggaatacatttgacaaccatagagaaaaggatagggagtggttacattgacctctaatgttgtaagttttctacattttatataaaatcttattttctttacttagactgaaaagttagagatatgcatactactaattcagagagcacacactaaaaaccactgtgaaaatgaatatctaaaaagctaagaacttttatgtcatgcaaagaatttggagtaaaatgctttcaaataattatttgctttaaacttgaaataggttaacattaaattattttaccttatcttggttgatgaaagtgttatttggataaatgaaaaacatttttaaaggcaacaaatagaatgaacctgggaagacttaacattgtgaaggtgtcagtgacccccaaattaatgggtaattcaatgctattccaattaaaattctagcattgcttttgaagctttttcttttgaaataattatagacttacaggaggttgcaaaaatagtttacagaatccaccgaatgcttcccctggctttccctaatggtgcatcacaggtgactataggaaaatacaattaactaaattacagagcttttcagttttcaccagtatttaaatgcactcatgtgtgtgaggtatagtcctgtgcaatattatcacgtgtagattcacacaataaacatcacaatcaaaacactgcttgcaccaccacaaaggcattccctcatgctacaactttatctcctttataatcacacccactcctcatccttgttcctgtcccctggcaacaactattctccatcactgtgttttatcatttcaagagagttatacaattggaatcatatggtattgaccttttgaaattggcttttttcactaaacatcaaatccttaatatccatgcaagatttgtcaagtagtagtccatggtatggatgtactagagtttgtttatccattcccccatttgaggacatttgggttgtttccagtttagggttattatgaataaaactgctatgaacgggccgggcatggtggctcacgcctgtaatcccagcactttgggaggccaaggtgggcagctcacctgaggtcaggagttcgagaccagcctggccaatatagggaaaccctgtctatactaaaaatacaaaatattagccgggcatgatggcaggtgcctgtaatcccagctactcgggaggctgaggcaggagaatcacttgaacccgggaggtggaggttgcagtgagccaagatcatgccattgcactccagcctgggcaacaagagtgaaactccgcctcaaaaacaaaacaaaacaaaaaacatgctatgaacatttgtgtacatatttttatgtgcacatgagttttcacttatctagaatgaatgtccaggagtgaaattcctaggttttatggtaattgcatgctcagttttttaaaaatttccatactttctttcagagtggttgtaccatattaaattcccacaaacagtatatgagagattgagtttctccacatcttcaccagcatttggtgttatcactatttttcattttagatattctaataggcatgtagtgacatctcattatggtaatttgcattctctgatgcctaatgatattgaacatcttttcatgtaattatttgccatctgtgaatcctatttggtgaaatgtctcttcatgtcttttgctcatctcttaattggatttttttcctgttgagttgtgagattctttgtatatcccagatatgagtcatttgttggatatgtggttcgcaaatactttctccctgtctgtaacttgtcatttattcccttaacagggtctttcatagagcaaaattttttaacttttaattttgtaaaacttttttttaagagctctaatttacaaacatttccttttatagatcatgctttgggtatcaagtctaagaattcttcaccaaatcctagatctgaaattttttcctatgttttcctctaaaaagttttatagtttatattttacatttaagtccatgaaacattttgatccagtttgctttaaaacacattctgagtaaatggataatgggcaggaatactcaattcacttcctcacacgaagaaatataactgctaaacaaatacacacatttcagtctcactattaatcaaagaaagcaaatttgcaataacaatagaagttatattttaagcagttaagttagtaaaaaatcaggccatttttcctgcagaattccccaccctctagatttggttgattgtattgacagagtttttggtcttttaaaacaggggttcccaacccccaggccatggaccaataccagtccgtggcctgttaggaactggccacacagcaggaggcgagcagcaggcaagccagcattactgcctgagctctgcctcctgtcagatcagtggcagcattagattctcataggaatgcaaaccctactgtgaactgcacatacaagagatctaggttgcgggctccttatgagaatccaatgcctgatgatctgaggtggaacagtttcatcctgaaactacctccccagtccccacttttggtccatggaaaaactgttttccacaaaactggtccctggtgccaaaaaggttagggactgctgttttaaaatgtaggtttattattcagatggtgtgaggccaaagatcaggagacatctgtcattgaaaagatagtttgtggccaggcgtggtggctcatgcctgtaatcccagcactttgggaggccgaggcaggcagatcacttgaggtcagtagttcgagaccagcctggccaacatggtgaaaccccatctctactaaaaatacaaaaccagccaggtgtggtggcatatgcctgtaatcccagctactcgggaggctgaggcaggagaatcacttgaacccgggaggcggaggttgcagtgagccaagattgctccattgcacttcagcctgggagaccgagtgagactctgtctcaaaaaaaaaaaaaaaaaaaagagagagagagaaaaaagatactttgttaccgacaatttcaaagggagggggaacaccatgccacaacatgcagggccacatggggaagcaccagggtcagtcagaaggcaagactccaagaacttgctccttcaggatcccacatcaaggttggtaaaagaggtgctaactacaggtgagggcaacagggccttccagtttctagacaagattgaagaggatgattatatccatggacaattaatgaattatctttttgtgtctgagaagaagctacataaaataccaaaactaatcaaaaatgaaaaagataacaggggctttagttacccaatataatgcaataggaactgaaatttaagcaattcaattttctagttggccacagaagttcagattctgaccttccctcctcagaggtaagaccatgcacaatagcgaggaattgaacaaaacaaaaaggacccccaagaagtggaaattccatacaaaagctctaagaggaacagggaggtttctttcctactcaacccattctcctcccaggaaggtacaaaacaaatgaagaaaacagagaagttttggacctggtcattggtctctaacctgttgacctcttattgactattcatttcctgttacaggaaaactcctttcccttttatttcacaatctggcacttttaagttcaggatccttcgcttagcatctaaagcctaaagctcttcacagcatggtcctaccctttcttcccagtcacgtttatttctgagtcataaaacttagtggctacaaagctaggctttggagtctgacagacttggtttgaattcctgttctgccatctcttagcaggtgaccaagttacataattgttctgagctttattctcctaatttgtaaggtcggaatgatgctacctataacaaatgagactgctgtggcagttatataagagaatgcatgtaaaacacttaatacgatgcatggcacagagtgatgactcaatatatagcgactattactagccctaaatggatcctatgatctcccaccttgttacttttgctcaagttgttcctgcctcctaacatgcctctgcctgtagaaattatatctgttgtttatgtctagtccccaaggctaccttttcaagaagtctttccttttgtttcaccaggaaatcctatccctgctttgaacctccaattcatttgtactcttcccttggcacttccttcacactgataagtgtacctaggcactgcccagggctgaccttgcactgagcagatgcttcatgactatatactgaattaaatccatgtggtgtccaaatgttacatgattttctggaattttaagaattccaaatacctgagaaataatgcaattaattccatatgtcaaaattgctgctaacaccctcaactcaatgttattataaaaacacatgaccaaaaactgaattggtggtgagaaaacatggaggagataatggtgaggaagaactctctgctggcatttgctgatgtgataatgttggcctccaggatatgcatgtgtcatatatttgttttggcgacctgccactgccattttctgctctgcccagcccgttttctttgggactagcaaaaaaataactaggaaaagcctgaaaatagttcacaggcaagcatcttaaacatctacaaatgctttttagatgaatggaaaagatggcatttgtttacagaagggaaaagacctaactctgatgcacctatcaaccttgatgtctcttgttctgcctgcctccaaatatcaacaaataatgtcaagggaaagtaagtgtggaacactaactacctacccacctcttccctggaaagcaaaggggtccaatacaagacaggtcttagagtttggatgctgaaaggtgtgcatcacccatacagcctcagtgggcacttgttatagaaccacagataagcaaaaagtactgcctcactgaagagggaagaagggagatttttcaccaactctgtggagatgcactgaaaaattccccccgaaaaaacaaccttagaaccccttgtggattactttcccatctttttcctggcctgggaatgtttactagcatgcgagcatataattttccatcatgaatgactcagagggagcttaagtgtcatggagaaccaagtaaatgattaattcaagtggattcaaactaagctgcttttaatattttgatggtgaaatgaataatgctcaattatcttcaagtcactcatagtcagacttaacacaggagatgatctgctgaagtgcacaatattgacacacactaggatgtcacttaatcctctgtgcacaaaaaccagagagaacaaccattctcttgaatggaagcaaccctagcttcatcttctggcctataacttcctcccttcctcttttcctctcttcctttctggcacagacatttaataaatacctcccatgtgcaaaaccctgagaaaggtactactgggaatacagaaatgaataatattgtgtcctcaggtagtttataagcttagcaggaaagataagattgtaataaaagcaaaaattagccacttgagattgttacagaatagcctaaaaactccagaatggctccctcaaaagaactctatcctggagatgtcgccacagtaagaggaaggttgacagatctgagaaattaaaggaacatttgcaagaggggactggggaagtcaactcactcatatttattataaattctctttcattgaacttatttcaaagacagtctttgtggcaaactttttgaggccttggatgccttaaaatatttcattcttacatttaaatgatacttagctgggtataaaattctagattctaagttttttccctcaatactgaaaattaacgttccactgttttcttctatctgggttgcttttgagtactaaggtgccaatatgattttgttcctttgtaggttatctgctttttcttcctgggaaggcttctttttttaaaattttactactatgtgtctagatatacgctttgtctcataaatcctggttggcaaactctgaatctttttaaactgagatcatccatactcccctaagattggagaattcttggtctttgtttcttcaaatacttacatcccctccacatactcttctccctctctctttctggtactcttattcaactgattggacatttctccttctaaagtatttttcctctacagtatttttcctatatttcccaactatttatccctttctgatgacttctgggaaagttgttcaatctagtattccatgtcattaattcattcttgatctgtatctgttgtttttacccccccccatcaagttatttcaacttatattttcatagctgctatttctgaatgatgttgtttgtaactgcctattcctgcctcaagttaccaacattgtctcttaacttttcaatgatattctagtttgttttcaatcattgttttgattagttcattcattctgctttgtctagtatattaagattgttgtctttcttttggggtagctgcactcctgaaaagatatgttatttaagaagacccgatgctcagtaacttctaaggttatttattaatacttacggcagttttttttagagcagcattatttattgaaatgttagtgtttgttttcctttttttaattatactttaagttctagggtacatgtgcacaatgtgcaggtttgttacatatgtatacatgtgccatgttggtgtgctgcacccattaactcgtcatttacattaggtgtatctcctaacgctatccctcccccaaacaatgagaacacttggacacaggaaggggaatacttactgcagttttttgactgaggagaccactttggttatcacttcaaaacagatttctcagactgatgtcagtgatcctactctcattctattaggtttaggtcatacattcatccttccaaaggttcgttcacccattaaagagacaatcttgcaaataagataaggcatcactgtggttgttactgctgtggttgcatagcttgaagtatcagttctgtgtgtagtttcttgaattagacaacagcactaaatattgtgagatattgctatttaaacttaaaaatacaatgtttagtgtcaaagtatgtcaactctaacatcccttcacactctataagtttatcatttagtttcataaggatatactactccaaataaacatcaatattttatgtatagaaatctatttctttagaataaacaaaccaagaaataaataaatttacttttacatgtaaaccatgcaatcccacacagaacaacagggaaaagatgaaagtctgtatgcaaagggtccaatttgtaacttactgtgcagtaaagctcagtctttaatcattttcttgttaatcttattcttaactataagctgcctcagggcattttcacagctttcgccagtctgtcccagtttagttttacctgttaatctatagactccaagtgctaaacactagattaataagtcctaagagttccaatatctcagtaagcacttttgccctgagcctaatcttatccagtaatcagcctttgcacagttcccatgtctcagcccgtttctccaactctcattatttttctctccttcttggagtatctgagctgccctttttgctggaggcatatgaaggcattgtgcctacccctagctgttcttaattttctctcttgaaggactctcagcaggcccaaagacacggcccttgcttctaggatgcagatgaaaagctgaagtggagggagaaaaagggcagttcactaacacataatgactaatcctagtagaataaagggcagggcccttttaataaacagtgcactccaggaagagggtggagccaattgaataagccccaggctctgatgagacaagtatgctcttggaagctgtcatagcaacaggagtttgctattcaagatgtggactatctctacttaaggcagttctctacgaccaggacatcactctctaaggccatcctttcttctcgctgtctttaagtacctggctctaactacctgcaaaaccagcctcctgcctcaaagcaagggctttcctttcctgtctagagagttaaaatggattgtaggagacgctagacaaatttagctctctcctccacagaagcccagtgttttgtggtgttacagaaaaagccctgatacaccagttcgcatgacccataattcttactgaattcatctgctgacatccagaagtgctgcttgaaaaatgatgatgtaatgatgctttatgaaaaggaatcaatctctgaggtggaaattcttactgtacaatgacacctggctagagtagataggatagtgcccatatgctattagctttggaattagtttcccactgggatagtggtagaaacgttttaatttttgtctcatcctatttaggccagcagccagttgaaaacatcccttcagagcacagcaattttgatggaggaagggcagactagggagtaggagagtatagtggaaacccatgaggcaggaccaaatgaatgaggtagcagtggttctcagctctggctacacattagaatctcccaggaggctttctttaaaagtttattttgaaataattttaaaattacagaaaagttgcaaaaacagcaaacagttgctgcacacacttcatccagcattcttcatgtcaacatcttttataaccatcagagttatcaaaactaagaaatgaactttggtacaatatgattaactaaactagattttatctgcattttaccagtttctccactacattgcattttctgttcagggtcaaattcaggatttcacattgcattgtctcctccaatctatggcagttcatccattcttttatgtctttgataatcttgacaccttgaagagcactgatcagttattttgtataatgtagctcaccagttttcccattaatgtccttttcatgttccaggatgcaatccagaatattatgtcacatttagtcatcatatcttatttgcttccaatctatggaaatttattaatgtttccttgtttttcatgatctcaataattttaaagataaatggtcaagtactttgtagaataccccccaatttgggtttgtgtaatgttttctcataattagactgggattatatattttggggaaggatagcacagaggtgaagtgcgtttcttatgacacagtataaggggttcaagatatgaacataaacttaccagtgatgttagtcttgattccttggttaaggagatttctgccaggtttctccactgtaagctactttaagaagtattttatcgatataattgtagaatcagatgaagttgtaaatacagagaggtcctgtgaaactctcactcaattttttctaatggatacatcttatgtaactatagtactataccaacatcaggaaattggcattggtgcaaagcatatgtgtaattctatgccatttaatcacgtctgtattcttgtaaccaccactgcaatccagaaatggaactattccatcaccacaaatatcttccttatgctacctctttatagtcacaactcccctcaccaacactgctaacctttgtacagcaccaatcagttctccatctttttatcatttttgagactattatataaatggaatcacatactgtccttacagtatgtgattgtaaggacaatggctgtgctgcagtcaagtataggctgaggtacacatcctgcacagtatgacacagtgggattggagcacaggcgcacaatcccatgcattacataatcacagctatgtagccataacgtgggagggctcatcacctgcctctgagccattatggtctgtgaggtgcataaatgcagcaccgacagtgtgaagaaactgctgaataaagccatgtcccacctacctggaacctaacagtgaccttttgagattgccttttttcattcagcataatgccaatgagatccatccaagttgtatatatcagtagttcattctttttttttaatcactgagtagtattccatggtatggatgtaccataatttttttaaccattcacctattaaccaaacacctgggttgtttctgttttttgatcattgaaaacagctctgctatgaacgaatttcatgtacaggtttttgtatggatgtatgttttcatttctctgagatacacacccagtaatatgattgctgaatagtatagtaggtgtattattagttttgtaagaaaccactaaaccattttccagagtggtcatactattacccataagcaatgtggaaagatccatgcatggaggtatagtaatatcacattatggtattaacttatatttctttaatggtgatgttgattgaacaacttttcatgtgcctatttgtcatctgtatatcttcttcagtgaaatgtctgttgctgtttgttgcttattttctaataggattttttttactctattgagttttgagagttatttatatattctttgttggatatgatttacaaatactttcttccagtttatagcttgtattttcatatttaaaaggatgtttcataaaaacttccacagaaagtttttaactttgatgagttccaatttaccaattactttttccttttatggatcatgcttttggtgtcaagtctaagaatctgttgcctagccttagagctggaagattttttccagttttctaaaatatgtttagttttatgttttaaaaacttacatgatccattttgagtaaatgtctacataaggtgtaaggcttaagttgaactttgtttgtgttgcctatgaatatccagttgttccaacacagcaccatttgttgaaaagtctatccttccttcattgaatcacctttgcatctttgttaaaattcagttgggaatatttatgtgggtctatttctgggttctctattctgttccattgacctatatatctaactcatctggcaatactgcatggtcttggttaccacagctatgtagttagccttaatgttaggtagaccgattcctccaactttattactctttttcaaaattgttctagttattctaggacctgtgtcttttcatataaattttggaatattactctgatttaagttctgacaagatcgtggaaatcatcactcccatccttacaagaagaagctggacaaacttaaaatcaatgacttttcatgaatccttcagacaaatgaggttgtagggcaaaccaccaccctgaaatctagagagtcaggaacatccagagagacatagctgcaatttgcttgcttggaccagagtcactggagtcacaaactaggaataccaaaactggtaattttaacaaattgctgcaggctgagtgtagactactatgagaatgacaaattgaggactgcaggcatagggaaaaccccaacattttgttgtctttaccttcaaaaaaatccaacaagttcttacagtaaagatctgagtaaaattatcttgtgggtctgtcggcgagagtaaaaaataatcattgtgatatatgccttccccttaacataggacaactttacaggggaaaagatttttctagggccttatctgagctggggaagggcattgctcctacctactccagtcccctctagcaaaactgcagaaaaccaaaggaaaaaaaccttgaaagacaagagagggagagaaaacaacttataaaggaataaggataagaattacatcaggcttctcaaggaaacatgcaaaaaagaagagagtacagtgaaatatttagtcttgaaagaaaaaaaaaccagcaaaccgcaattctatatccagtgaaagtatccttcagaagtgaaaatgaaacagttttctcagaaaaacaaaacaaaaactgacagaaatgaaaaccaactggccctgcaagaaatgttaaaaggagttctttagggggaaaaggttatagtgatcagaaactcagttctacagaaagaaaggatgagtgtagactgttggagaaggaatatatgaaggtaaaataaaatcttttatttatttttctaattcttagctgatctaaaagaacacctttttttttttttttttttttttgagacagagttttgctcttgttgcccagcctggaatgcgatagcacaatatctgctcactgcaacttccatctaccaggttcaagcaattctcctgcctcagcctcccaaatagctgagattacaggttgccaccaccacgcccagctaattttgtatttttagtagagacggggtttctccatgttggtcaggctggtctcaaactcctgacctcagatggtccgcccgcctcggcatcccaaagtgctgggattacaggcatgagccaccatgcccagcccaaagataactgtttaaagtaacaatagcaacaatgtattggttgattatagcatatggataagtgaaataaatatcaacgtcacagaggattggagggaagatttgataactctgttatggggcacctgcactatgagtaaagtgttacagtgttatttgaaggtagactcatagttagcaatgtatattttaaactgtagggcaaccattaaaaaatttaaaagaagtataattgatattgtaagaaaagagataaaatataattatataaaatatcaattaaaaacaaagaaggcagacaaaagagttgggatatgaaaatgaaaacacaatagaaaatagttacaaatgtaatccatattaatatatcaataataactttaaatttgagtgacctaaaggcatcaattaaaacagaggggataaaaaaatcaaacaagacacacctatatcttttctccaagaaatctactttcaatataaagacttatataaaagtacagagatggagaaagatataccagtctaacataaaagaaaactggagtatctatattaatttcagacaaagcagaattcagaacaaggaagattatcaggaataaagaggggcatcatacaaattttagaataagtttacctacaaacaaactttattgaaattttgattaaaattgcattaaacctgtagatcaatttggggcagatttgacaactttactgggttgagacttccaatccacaaacacagtatttctctccattaatgttaagtcttcttgatttccttcatcagcattttgtaatttttggcatacatatcctctacatgttttgttacattttgttaagtttatacccaagtatttcattttttttgtagcaattgtaaatggtattgtgttttgaattttggttttgatgtgttcacagtatttgaaaatgtagttgatttttgtgggttgacattgtgtcttgcaaccttactaaactcaattattaactctagaagttttattgtagattctttgggattttctacatagacaatcatgccacctgcaaattgggagggctttattttgtcttttccaattcaagtgcttattatttctttttcttgctttattatactggctagaatttctagtactatactacattgaataagagtgatgagagcagctatccttgccttgtttctgatcttagtgtatctttccctttttctgatataagcatttactgctatttgtttccctctcaatactcctttagctgtgtcccacaaattttgatatgttgtatttttattttcactctgattaatttattttttgctccatggattattgagaagtgtgctgctttgtttccaagtatttggatattttcctggtatctttctgttgatttcaattcttctaaacttcttgaagttgctctacagtctagtatatagtttatcttggtatatgttccatggatgcttgaaaaaaatgtatattctgctgttgtgaggtggaggtttttataaacactagattctgttggttgatagagttgttgtgttcttttatatctttgctgactttctaattgttctataagttgttgagagaggagtttgaagactccaactataattgtgaatttgtctgttttcaattctattgaattttgcttcacatattttgcagctctgttgtttggcacatacccatttaggattgctgtcttcttggttactgacaatttaatcatcatttaatgaccccttctaccttagtaattttctttgttcttgcgtctatttacctaatgttaatacagccattcccactttcctctgaatatttgtgtgatatatctttttactttcaacctacttatatatcaaatagaaaatataaatagtaaatggtaaaactactaaatttccgtttcatactttattagaactgagacagaaagtccagctcacactcaatgaaggggaattaatctctaccacctgtagggaggagtatcaaataatttgtgaacacatattaaaaccaccatagtaattaatacaaatttgggagctaatagtttgtagctatgtaaatatcttgtcctctgagattactactgtggtgtattctctctctcattagctatttctctaaggaggtctaattctttttaattgagaatggtatttaggaaacaagatgtagttctaggtaagcttaattctacttcagtgttgctgcttctaggccctctcagtggacagagctatgaaatacagtcaacccaaacctgagaaaaacaagcaatggggaaaggattccctatttaataaatggtgctgggaaaactggttagccatatgtagaaagctaaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatggggtctaattaaactaaagagcttctgcacagcaaaagaaactaccatcagagtgaacaggcaacccacaaaatgggagaaaattttcgcaacctactcatctgacaaagggctaatatccagaatctacaatgaactcaaacaaatttgcaagaaaaaaacaaacaaccccatcaaaaagtgggcaaaggacatgaacagacacttctcaaaagaagacatttatgcagccaaaagaccatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttgctgggactgtaaactagtccaaccattgtggaagtcagtgtggcgattcctcagggatctagaactagaaataccatttgacccagccatcccattactgggtatatacccaaaggattataaatcatgctgctataaagacacatgcacacgtatgtttattgtggcactattcacaatagcaaagacttggaaccaacccagatgtccaacaatgatagactggattaagaaaatgtggcacgtatacaccatggaatactatgcagccataaaaaagatgagttcatgtcctttgtagggacgtggatgaaattggaaatcatcattctcagcaaactatcacaaggacaaaaaaccaaacaccgcgtgttctcactcataggtgggaattgaacaatgagaacacatggacacaggaaggggaacatcacactctggggattgttgtggggtggggggaggggggagggatagcattaggagatataactaatgctaaatgacgagttaatgggtgcagcacaccagcatggcacatgtatacatatgtaactaacctgcacattgtgcacatgtaccctaaaacttaaagtataataataataaaaaaataaaaataaaataaaataaaaaaaagaaaagaaatacagtcaaccttcagtatccacagacgattgcttccagaactccctgtggataccaaaatccatgttggataccatgaatgctcaagttccttatattaaatggtgtagtatttgcatataaattacacacatccccttgtatactttaaatcctctctacttacaatagctaatataatgtaaatgctatgtcaatagttgttagaccatattgtttttcctttgtatgttttttattgttatattgttattttttattgttttttttcccaaatactttaatccacagttgcttgaacccacgaatgtagaacctatggatatggagggacaactatatacatatacatatacacatagatacatatccatgaatacacctgctatggtctgaatatttgtgtccctccaaaatttatatgttgaaatcttattcctaatgtgttggtataaagaggtgggtcattttgggaagtgattaagtgataagggcagaaacctaaagaatgggattagtggccttataaaagaggtctaaaggagcatcttagctccttaccccttccaccatctatgaagcaaagaaccctcaccagatacagaatctgctggctctttgatcatggacttcccagactctagaactgtgagcaatatatttctattgtttataaattacccagtctaaggcactctgttatagtagcctgaacagactatgacaacaccatatcaacattcatttctgtatctacttatctttacagatagacagatagacagacatatttactgatttttcatattgatctctctgacgctaatctagtatcacagggtttattctagctttcgctctttgcttatttctactttctttctacaacagattctctggaatgcctttaaaaatgcatatgcctagagccctatccaatgccaattaatttggatatatccatatattttaaatatacccccagacaagactggatacatgatttttggggcccagtgcaaaatgaaaacgtggtgtgccttattcaaaaaacagagaaaaagtgtctttaaaggtactaaaatatacagatgttttcctttcttctgtggtttctcattcaacctgtcatggtgtttcctctttgctattcagtgtcactctaagtaaagaaaaagtaaaattttaaatcattaatagacattttagtgttcatctttatattgtacgacacaatgatatcttaaattaaaatatcagagcatttaactcctatgcagaatcaccaacattgtacaatttgtatttcatacttcatctctggaaggtgccttgagctggctagaagagactaatgcaagtcagattcaggaaggttgaaaggagaaagagagggtctctccagacatgaagcaggcccaaacgatactctcttgggcatggggatattcatgggctgagggtagacccttgcaggcacccaggagctccacccaatgacttgtgtcttgggtgtgtgattgggcctgacaactactgggtccctttcaccagccatcagactgacatgctgtgccttatcagaaggtaaggaaattgaggtttagcatctctcttcccatgggcccaccatcccctcccacagaagacagacatcccccaaggatattacaacctctttaccagggtacacttaggtacctaaatcagggatagacaagaggcttgctgccactgtgtttcccactgaatgtgcctggtgctgtgaaactggagcagagatgatcgatgtcatgccctccctagaggggctgcaaggtgcatgcatctgatcctgactctcccaacatccaggctcctgctggggatggatgaacaaggatgagaaaggggggcccaggtaaggccacgggcaccagaaatcaagggagtggtggccaaaaacccatcctggagatgtggggagtttgtaggaggtagatccatatgtgaatcaagatttcaagcccccagtacatgcttcattgtctcattacacttcacttacaaaacacaggtttgaagataaaaaagataaaaatcattaagtttcaaatggaaaccacagaacattaatctcaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagcaatgggatggctgggtcaaatggtatttctagttctagatccctgaggaatcgccacactgacttccacaatggttgaactagtttacagtcccagcaacagtgtaaaagtgttcctatttctccacatcctctccagcacctgttgtttcctgactttttaatgattgccattctaaccggtgtgagatggtatctcattgtggttgttgtggggtggggggaggggggagggatagcattgggagatatacctaatgctagatgacgagttagtgggtgcagcgcaccagcttggcacatgtatacatatgtaactaacctgcacaatgggcacatgtaccctaaaacttaaagtataataataataataataataataataataatagaacattaatctcccagcatggccctcccttctgagcatggggtcctgtgtaaatgcactggtcacatgtctattaagctggttctgtctctggcaatcctaatgtgcaatcatggttgacaataccaagctatatactaaaaaatcggtggtcaggttggttttgctcaaactctcaggctgccagagcttccacagaaaataatggatggagacactgacctaacagtatctgagaggagatcaaactgggtatcattgcctaaggcagtggcattatagtgatcacagtaagtaagcaggaaggtcaagtcctcagttttgaagaaaatctctaattatctctccctctcagagcccatggtcctatctcagtacctgctggttgcatgttggcctgccatgcccaatgcgagggattttaagacacaggttatatacatctaatcaaattgcaggtgccagataagccacagaggccacctttcccagactcttctcctctcatttattttacctaccagcaggccaagaaaggacctcaggctgctccaggcagccacctgggtcctgggtccagtgctcatcagccaaattccagaactagaatatacaaaccctctcacttctagcccccagcatgatcaagttcctcaagggccttctttctttgttatccaatcttgactctttttagaaccttttagcctgtgtcaactgctcggcacatagcaggcactcactcaatggttgtagcctgatggattggctcacttttggcttgctcacggatcagttcttacattctctcccctagcttccattgccttccttggctcctcattcaagcagaatgccttccacctctcagcattctctctctgacctttccctagtaccgaaatgtacccttatgataccagtataactgcatttacattacagggcaaagagaaataaactgagtacatatctggagatttatcagaggccctttctgacaccacaatcaagtggagtttatcacaagattgtaaggttgcttcaataatagaataattcaattgatataactgatcatactaagtctaaaaaggccacataattgtaccaattgatatagaaaaagcacttgacaaaagccaacatccattaattattaaaaataaatctcagcaaactagaaatagaagtaaacttttctcaacttgaacatctccaaaaaacctacagataacatcatacttaatggtgaaaatctaaatgttttctcctgaagactggtagcaatgtaagacatccactcttaccacctattccacatcattatggaagtcttagccaatgcaataaggcaaaaatcaatcaataaaaggcacagatatcagaaaaaaagaaagaaaactctgtttgtaaacagcatgactatctacacagaaaatctcaagaagtctacataaaaactcctaaaaataagtgagtactataaaggtgatggaatacaagtcaacacacaaaaatcaagcatatttctatataccagcaatgcaccactgaaaaccaaaatttaaatatatgtatacatttaaaatttataatagctcaaaacaaatttaaatacttaggtataagtgtaacaaaatatgtacagactctgcatcctgagaaccataaaaccctgatgaaagaaatcaaagaagatttaaatagagttataccatgcttatggactgaaagaaacagcataatttaatgcaattctaatcaatatcccatagaactttttgtatttacagataagtggaatgtagaatttatataaaaagcaaaggaactaaaagagctaaaacaattttaaagaaaaagaataaaactgtagaaataacattaactgattttaagacctactgtatatacacagtaatcaagacggtgtggtattgtcaaagggaaggacacacagatcaataaaacagaaaacagagtctaaaaattggctcacataaacatagccaactcattgttgacaaaaatgcaaaagcatttcaatggagaaatgatatgttttttcaacaaatggtgctgaaatcattgtataacagtatgaaaaaaaataacattaacctaaccttacaccttaaacaaaaatttactcaaggtggattatagatctaaacatataacataaaacaataaaatgcttagaaaaaaataggagaaaattttcctgaccttgagttacttgaagagtacttggatatgacatcaaaagcatgatccataaaaacagaagttgataaattggattttatcaaaattaaaaagttttgttcagtgaaatacactgttaagagaatgaaaagactagctacagactagaagaaaatattttcaaatcacatatcttacaaaggccttttatctagaatataataaagaactctcaaaactcagtagtaagaaaaaagtccacttagaaaatggggaaaatacatcaaacatttcaacattacatttcaacatagatgtgtagatagcaaataagcacatgatactttcaacattgttaactattagaaaaatgcaaattaaatctgtgatgagatagcactgcatagttgcatagttgcaaaagagacctcatggccttcaaagcctaaaatatttactttctagggctttacagaagcactaaaatatgcacttatccacagtgttctcaacacatctggtgggctacaaacaaacactgagtccacatttcatgtatggctatcaaatctgatcagaactcttaccagtactggacagtataggaactgcagagcaattcctgagggtttgccctcagcttaaacacacacttccacccgcccccgccactttttactatgtaaacacctctttaccctttaggacttagcccaagcatcacctcttcctgaagtcttctctgaccattcatttccactccaggctgggaaaggaaccttctctttattcccatgataccctctgcatgcttttgtcactttgaaatagtatttgctatggtctgaatgtttgtgtcactcccaaattcatgttgatacctaatccccaaagtaataatattaagagatgggacttttaggaggtgattaggtcatgagggtggatcctcatgaatgggattagtgctcttataaagagtgctcagagagtttattagcctcttgcccttttcaccgtgtgaatatgcagcaagaagggaccatctataaaggagagagccttcactagacaactaaacctgctggcacctcaatttttggactttcaagcctcaagaactgttggtgataaatttatgatatttataaaattttccagtctaaggtatgttgttatagcagcccaaatggattaagagtgttttataactgtttgcttgtccctctctccaacaagagtataagctctttaaggaaaggaaaagtatcagtctttctatcatcgctactcagtaatggtgatagaaatatagtgatgggtatacttcataagtgcttattggatgaatggacagatggttggatgaatggatagacgagagagagagagacagaaagaaactgagagagagagggtaagtccatttcctaaagtcacacaagttttatccaaattaggacatcccttaagagcaatctcatcatctctctactgtgggattatttgatatactctctcacccaaaccacgtgtgtgtgagtgtacatgtgtgaacctacttttgtatgatgttgtgacaaaagaggacttattttaccagctgcaacccacaaaaggagacaccaaagccagagcccagttatcctcatttgactcagaccctcactgtgactgtgcatggtagccccactattagggttgcatactaaccctggattataacctcttagcactcacaagatcactcaaattccacttgccttcactgaacatatattctatgccaaactgagtgttggatactttcacatcaaatgcctcactgaatcctgtatcaacccttggaggtaggtagtgatcattacttccattttagaataagaaaattgaggcatgagtggtaaacagagaacagatactcagctcaacgggaaactagatagtaaggcacttaaatcttaatcctagattataccattttgatgtcccattatgaagccatattatgagtcagggagttattaaacgtttaattaaaggtttttggaaagaagaaaagttttcactgcaataagtagcactctaggtaggggaaacctggtcatctgagttgatcctgaattaggggcatttgcccaagtcattggcttccgtgcctgcaaggtacaaaaggagagatatcacctgattaaaggaaagactctatggttgaccaagggcctacatgttctagggtatggatgggggagctcatgatgtctttgtctgcaggagaagagatattcccaagagtttctttcaaattaagagataaaaagcggaagaagtaaaacagagaagtgaaggaaagaaaaaaacaccataaaatgccatttcttctgccttagcaaggtcagttcaacacagtatgtctctcctcttgcttcctttctaatctcactccttagatcacgtataaagtatttagctttattacttttattaagacataatcattagtgtaaatcacaaggtcagaaagccatacatctttagggaaatccaacttgatgtggtgatcaataatttgtgtattcaggatcatcaacctcactgcaccttttaagcatctatcaaaactagtgttgatgaatggaaatactcccttcaattttaagtaaatcttagggcataaataatccaagctcagacagcattctagtgacaagataggccaaaccaaaatgggctacacaagtgtaaaggccttgtgttaagaattgttgaaccatatttcactcagtgtaaaggttttcatttgaagtagatttaatacagtccattccaaacaggccctttgcaattcattgggagctttaagaaggtgggaaactttaaaggcacactttattctaaaatcctttgttggacacctgaatacatacaatgacaatcattagcaagaataaaggttttatctcatttccacagtacattttacttaatatgtctccaatcagcagtgctctacctctggaattccaagctcaacttgtatctaagcactgtcaaatgaaaaggagataataaaattactagtgtgttgcaaggtgattaaatttacataatgactctggatttgatcaaatgccagatccccctctaaaaaaattacctgtagaggcattaaatcttccagccacacacacttcactgcgtttatgctttatccacagaagctcccgtttatcttagcagagattactgccatcccaccacaggaacacagcatgcaggtaatgcctggaagcttatttagaagagtggcaggggctcatgctgctgatttgcagaataaatatcagaaaaatgtgagagagacattgtgttcatccagagaacagactgtactacagactcagatgcagactttttctactctaccaaaaatggaatggcttcttaaaatgccatccaaacacgttctcctgaaactcaaggcttccccactactaacaaactctaaggagcttaccatgagcgggcctttccaggagcaaactggtgagaattcaggctatggtgtgtcagatttggaaatccattcctgtcaagctggtaggtaactaatgcatgttctctcatcctaaatatcatctcaaaataggattgcatagtgggatatttccctgttgcttgtttgctgcatggccctggatggcagtctttggaataaaaacaatcacacaaacaagtaaaaaacctatgcattatagtaatgacacacagccaagcaaaaggcaccatgatacagcttccagaatactcatcatgcctattgaaaaaaattacacaaccaaagagctctgaaatatgatttgcttctagaacataccactgcaaattggtggtaccagctcagagagaaaaagaagtcttaccactttccaataaaacatcaagaatagggactgtagcatcagcatgttgttgactgggtccagactgcttttgtcagataaaagcaattacttctctactatgactgatgtaaattggtcactccacatatccctagcttcagtaacaggcagagtcttggctggacaactactaaaacctaaaccccactaaagctcttgctgttcaatgttctatgttatccatccctttcaaagcatcccactgtttgctattaaatatgcaccaatctcttgccagtcttctgtagagatttattttattttatttattttctatgcaacaaaagccacattcaaaatcttctgtaaagatttagaggtagctatggtcctcctacagcctacctacaatacacctgtactgcattcagtgaagataagactcaagtctcaggtcagcattatcagtaaattttagagttaaccacaactgtagcaggcgggttgcctcagcaacctgtaacaatactttagcatatgtccaaccaagagtacttatgaaataacctataaaaagtgccattattggactacttttcatgcgtgtaacaatttgtatataaaaagaccaaattttcagttgccagcaccaagtaaggactatatactagtggattaatgatttctaggcagattttattgcacttaagaatatgtatgagtacaataaataaatagtttgagaggatacatgatgtcttttagtatttcaattttttattagttgttaattttcgtaatagtcatttggaaggctaaaactgaaatttgtttccctgaaaaaatgtttttatcacattggttattatggaagagttgttgtgagtcatgaaactgctgtgttccatttttctttaaaaaaaaaaaaagtccccagggaactcagggaattaaactcataaatttaatttcaatatctggtaagctgtgaggacaattattaaggcagtcatttatgagtatctaggggaaacccaagtgataaacagtagtcaatacagattcttcaaatacaaatcatgccaaacgaagctaattcctgttcatgatagaatgacaagctgaatggtgaaagaggatggagcaaagttaacatatcttggagagagaagcatctgatataatttaacctgacattcttatagtaatgtcagagaaagaccataaatagagctggtaaagagaaatctgatggcatagctagactggtttggtgtaagctcaatggaacatgttacagagtaggataaattccagatgcaataccacccagatcatgcataaccactcttaggttatatcaacacagactgtaatcatagtcaatgattatacaaagtatatgtagttacatacacaattgggagataaatgaataaaatacattattgatatatcagagtcgtttacatcaaactatgtgtcaagttttttaaagtcaagtatttcccatagagaatcttcaccaaatgagtacaaatgtaactagaaggaatttgtctgtaaaaggggctaccgagaagaaccaagtgctatgatgacaggaaacagactcctttgtgattttgaggggtaggtattcaagagtccccttaacctacagagcaagtccaaactcttagtctagtattcaaggctcttcataaactgggtcggacttaccgctccagctgtatgccatgctgctctccaccttaccagactaattgccatgcgttccctgggactgcacacctgcagagtgtgtggttcttcaaactaaactacctttcacctcaatgtcttcctataataatctcatcacccctttaagacaaagctcaaaaccaccttctttcaaacagcattccttccagatactctaattcgacataattttttactcctccaatatccccttaacaccttgtttaaacttctgtatagacctttattattgccttctttgtatgagaattaacagtgcacatgtcaatttctcattacagtgtgaactcctggagagtgagagccatgtcttattcattctttatcttcttcacagcaggcattcaacaaatattcattgaattggattggattggaactggaataaacacaccatctagacatttattattgggaatgcccccacgattccagggccaactgtgatcggtttggcctttccctttccagattttcaggctaattttccagtgctggaaataaactaaaaataataaaactaaaaacctaaaaacaaacccctttgtaaccattaaatttctatcagacagtgaataaaggacagttacctaacatctgaaatgcctttccttttggatactgaggaacttagaaatgttcaattctgtgattgggccatgatcgcatcctgattctgaatccctaaaacgtgaaggcaaggcagctggagagccaggattggagtccaccagaagaaggcagagacagaaactgtctcttggttaccaaggtttctcttagaaaaccccattcacacaaatctgaattcagaggcaacacccagggtgagcaacactgataaggaaactagagagttctgatcaggaaaataaaataaaagaccattccctcttgtgtcttggtgttttgggtcaaagtaggagttgcaagtccatagctctaactaatttacagtataaatgtattaaacaaaaatgcacaatagctggagattctgcctgaggtcttcataatgtcattacacaggaaaaactgtgggcttcatactgtgggaatctctttttggcttgtattataagcaggaagtgcttcttcccacccaagatccctcccatggtttagcttgtaagaaaatgctgttccagcatgagaaaactcagctccaccctctggtatggagtctggcatgcagtgttatgttcacagtgtggctattattgtggcttgccactagagaatcgcaggctcatagaaaagctagaaatactgatttaagggaggcagtatatatattgattaaaagcatattttttagggtcagataaacctgggttcaaattctagttcttccatctaccagctgtgtgaccgtagacaatgtccttagccttcctgtgcctcatctgtcactttggagataattactgcacctccctcatgggtttgtcatgaggattaaaggaaattatgcatatagtaaatgcctaaataagagtgagctagaatgaaagctagtgaggtcagaagtcactgacctcaagttccaaataaacaagaactttatagttgataaggccagaccagaaaatatggactgaagcggtaggagaaaacttatgaaaaggataaaataaactattagaaagtattgggacaaactctgaagcctggtttgaaacccactttgagagtcgcccaaggccagagtggacacatggtgctcaggaaggaaaaccaatcaagttaattttcatctccatggagcatttgcaagccaccagaagtcttcaagtgtcagaatgcataactgggtagtgccctcaatatagagaaaaagtaaaagaaacctgaagacagcaaatgaacactgaatttacacattcaaaatcaaattcagtgccctatatacaaaacttatcaaaacctcagggttttcctaaagttacatttcaaccatgtagcctttaagggagtcagcaagactgcatgtgctgacatggaaagcatggaaagatacacatgtgacatggtttcaatgtgtgtcctctccaaatctcatgttgaaatgtgattcctaatgttggaggtgggacctggtgagaggtgactggtcagcccctttagctgcttagcatcatcaccttggtgataagtgagttgtcactttgagtgcacatgagatctgtttttttaagagactgggaccttctccgtctctctcttgttctctctctcaccatatgatgtgcctgctccaccttcgttttccacatgattgtaagctttctgagggcttcaccagaagcagatgccagcagcaaacttcctgtacaacctgtagagccatgagccaattaaacctcttttctttgtaaattacccagcctcaggtatttctttatagcaaagcaaatggcctgatacaacatggaagtggatgtacaaaacttgtgtttaccatgctccagtctgagttttctaagaaagcatatataagtaaatgtgtgtatgttacctatatgtacatatatgtatgaatgtatacattacatacacacttatatacatatagaaaatttttatagggatatgtaagaaattgttattgatgttatacaaaggagtgaaactaggagcttgatgtggaagaggatcttcttttcattttatatgcttttgtactgtgcatttttaccataagtatgtattatttttataatttaaaaagggacaacaaccccagaaagaaataactctaaaaactcagtacattgtacagtactttgcatgaagtaggactcagtaaatacttgactgaatggatgaaagtcactcaatcaccccatcagttggtatatgggatggggaaaagcatatacaaagaagagaaaagaaataaaaaaggagaatagcaagcaccaacttggagcagttttcattccctcaaaagataaaaaaaaatggaaggaaagtcaccaaaggaaaaagctgacaagtatcttccccaccccagtggtgcctgctgtcaaaaattgcaatgtgctttgcaaatactgtctgcagatctgtgagagggtgtaaacagaaggctctttaaagagttaatcaaagctgtgctgtgctccaaacagggaaggagcagagaagaggttaatgtcctcctcgtggccatgaaagatgctttgccatgaggatgcttctcagtgaggagcccagggactacatggaaagtgcagtaaaacgctccacattggtactaataggtgccatttgcagaacactgccttcccaaatctgaaagtttgtaatgaaatgcttttccacaaagagcggtagaaattatgggtacaaaaccccactaggttatccacctgtctcttagattggatttaattccatataaatcctgatatggatttaacactacataaatcctaatgctttcaatgatgtataagggggatttacactaataaatcctaaatagaaaatacaggcacaaagcaacaatactaaatgcaaaggaaagagagtcaccttcactgattcatcttgatatataccaaggtaattatgaactgccagcatgtttttaaatttagggtttttttttttaaagaaattacaacttcattgaaagtttaatggatgaagctatcaaagtcaagttaaaacaaacaagcacagatgccattttcattgatcaatgcaatttagtatcctcatgggacagaaccaaattcctgaacaaatataggagagaaataaggaagcctggccccacagcaagcacagtgtacctttattttaacaagggcaaacttggcctttggtcaaggtggtgagactgagtgcagtagccttgttgccactagagaagtccaccagaaagcagatttactcatcaatgaaaactatatagatcattttcaattttgtaatttagcagttaggggcccttataaatatgttgtctatgttatttcactttacttttcaaacttttctattttccctccattctatccagttgtgaaaactgggacacttccaaactttgggacaattactcaccaaatggctcatagaaaaagcacaaccggaatccagacttctcttctagcaaacaacctttatctctttccttctcctttcttctctaccttacttattgtcaggagatgtgagtgtgaggcctggctgtgccaccaacttgctgtgtggcctataaaggtggcttctcttctctcaggttcactctccctatgtatacaatgaagaagtggactaaatgaatgctaactttcaatggcattgactccattaatataaaaagtccttcttgatcccagtattaacctgacagagctggaggccttttctagtctgatccccattccctgatggaggatacccagcttttggtgctctcttcaggagagtaaagcttctctgacaggaagatgagagacttccactcaggctctggattagcatctcagaaatctgagtcaatagaaatcatgccaaccaacctctatggcacaatatatgctcacttagtagacatagtaataattaattattattactcaaatattactcaatattttatgactattggggtaaaagaactcataatgacagctcactcaaggctctccataatcctgcaactgtctctgctcaaagccgcattgctatcttcatgatatctgtttcagtcatggttatccagagagaacaaataggagatacacacacacactcacacacatgcacacgctcatacatgtgcatgcacacacataaacacacacaaacacattgtcttagttcattttgtgctgttctgacagaataccacagactgggtaatttataaacaacagaaatatgttttccacagttctggaagctggaagtccatgatcatggtaccagctgatttggcatcgagtcaaagctgtctccacttccaagacggcttcttgaatgctacatcctccagagggagaaacactattcctcacatggcagaagagcaaaagagctgagagggagagagcaaaagggggccaaacttgcccttttataacatactcactcctactcaacagcattaatccactcatgagggcagagccctgtcgatccaatcacctctcaaaggccccacttcctaaatattgtcacaatggcaatcaaatttcaacatgaattttgaaggggacaaacaacattccaaccatagtgcatgcacgcgtgcgtgcatgggggtgtgtgtgtgtgtctgcgtatggagagagagagagagggagagagagagatttttttttttttttacttgggtaggatttttaataacaaatgagcaatatattttcagcaggctatatatatgctgtaagataagctttatagaagcagtacactttgtatcttatgttgactactaataatgattttcatataaaagcacagcaaagcgatccatgtacaaagtaatataacccacttaaaagactgcacaagcaaattaaaataaatggggaaatttctcagggaataaaatttcttgaagattagaaacactgttcctcaataaataagcacccctggaatgtttagcacaaaaactctatgcttgatcgttttactatttcagcaggactgtcagagaggttggtctttgtggagtcctgttcctttcaggtgttagagattttaaggaactagttcagatgattgtgggagatggtaagtctgcacatgcagacaggctagaaacccgggtaagaagtgatgttacagtctggaatccaaaatttgcatggctggtcaagcagcctagaaactcaggcagggtttccatgttacggttttgaggccaaatgttttcttctttgggaaaccacattttttttttttaatctcaaagctttcaatgaattggatgaggcccacccacattatggagggtaatgctttactcaaagtttgctgatttaaatgttaatctcatctaaaaaaatccctaaacagcaatatctagactagtatttgaccaaacaactgggcaccataagctagtcaagttgacacataaaattcaccattattagtgtccaaatatggtctgcctttgctgctcacttaggtcatttactcttctcctttgaactgggtttaccttggactagctgatactggctttgcaccctttgcctggtccctaaatcctgtcataccttataagaatagtcccacacattaggtctgctcttcttctaccctttaactgcttccagaataacttgagtctaagctaccagacaagcaacagcaggcaccaaacaaaaagaagccagtagcccctgtactctaggtcaggaaattcctctccactcaggaaattcctctccttcaaacttcctcatgcattagctctgctggccccgaagtacttggctttgtgtactgtctcgctggtctcatctagctccatgtcaagctgtttgccttcactctgacctcaggatgttgatccaaatcttctctgtccaccaatgctgggaaagaagtcccatgtctgtaaactccatccatctgggaaggaagactagataacctgtatgatgcattacagttcttaaaacactttcacatacactacccactaaccggtattccttgacattgtctgaaagcttataaagatatcatccacaaaacctcacttgacatgtaagaaaattgaggttcaaaaagtgtaagtcctcaacacaaggacatgtagctagccaatacacgtgaccctgctatggagctgaagctctgggtcatttcattaagccagaagcaccttggcaaggagctgaatactactagactaagtactactactactaacaatgccaccttagattcatatgcaacttagcttccaaaatgatcacacaggcatttctcaccttcacctaattttctcagggtggctcaaaaattcccaacagcatccctctacctactgtaggctacaaagacacaaaaattctccttcatcatccatctcagaatattaacttgaaattagcctacaaggtcatcaaaagcaaagttttacaaggttgttcattaactggtgcatagtgactgagaaactagacacagtagctttcatctcaagggatgggcccacaaacctggcccaggcagggcaacctggcccaaggactgcccatatagtcttcacaagttataactgaaacttggctgggactagaatagaccagcctggggaaatctaaaacatagagactaggcaggcccattatggctttgaggttagggtctccaataagagatgagaagtagagactaataatctgtgttgtgtaggcccagacatgagttagagggcaatgtccccacagagcagatgaagcacaccttaagagggtctggtaataagcagcaggcagaggtccaggcaaggcaggccagcagcctcactgaggatcaacagtaagcaacaaaaggctatgctggctagtaggctatgagacattgtggagtcttggacagaagccttagacaaatatctccatggataggcagatgagtgatcccagagaattctggcagtggacaagcacagaccccaggaagactgaaaaggacaacagaatttcagtcctcagtggaaaaagacaccaagtacaaagccaaggtagggaccaggctctctaataattaaagaaagtaggtagtagacagataatgagctcctggatatggaagagaaggcaaggtgtgccagtcccaggaaggtggcaacaatctatttattaggactgaggggaaaagtccaagatcaacttgcagccatactgcatccatgacctgcttttaagactgtggatccttcagatctctcttgactacaaggtagggcctcagagccttgctaggtagagtggagtaaggtgcagggcctcattctgagagtcacataggcccagttgtggggaaaggaggactgaaggagcatgaagccaacaggcccattatagggtttgttgagtggagaaaacactttcttatccagggaaaagcctgtagggggaaatcacagttctctttacatgtcacccaccactctgatccagggatcctgggatgtgggtctctctttcttatttcacaggatgtcagtaagtaccccctagagccacagccgggggaaatagaaccctaactattccagaatcctagaattggaaggcagaagagttcaacacctggcatttaaaaaatggggaacctgagatctgcccaagatcacctaataatttaatcatagaggctgagacttaggtttcctgactcctagcctgaggttctttccactaaaccccaaagatgaatattctgacacccacacgcatctgaagatggctttatgacagccccaatttccatctatgccttggacaatcaaactgatttatctcatttggcttcaaaaaacacatttatagatatagatcaagtaggggagacttcagcaaccaccatatataataaattaactttctgtctaaagcctgacttactttgtcatttgagaaataatggaaatacctacaatatgaacccctccacaaagcgtgatatatttagcaactttcagtagcatgttaatttcaaaattccaatatttccccgttgctatagctatggcatctggttaaatcagagttcagcagctgtgggcaatgctaatactgattccagccaactttttgctttgtttctaatgcaggatgaggaaaatgagagcaaaacagtcacattctctcccactccctccaaggagcaaaaccccttaactagtctgagttagacaacatattaattctccatctggcaccaatacaactggagccctaagtcccaaagtattgaattgatgatgcaagtaattccagatctataactgggagttacatgttcaggacatgctaatatgtgaaagctgtgatctgctcatccagagaatcttgctgcctcgtatagctgcatgcttttgtcaattccttttacaaacataccatttgaggattcctggacaggaaaaaataagggctttcaaatagagtcatcactttgggctacacagctcacagctttccattttgagctactattatttaagggcttcttttactcaattttcaagagaagttatcttaggcaggtttcttaggtctacacactgggtccattaatgggctctaatctgtctacacagccctctatttccttgactccaaatagtgacttggtctctaaatgttattccaaagatttatgggccatcataaatacacatgacagagtattcccaaagttgtgacaataaaatcaatacagtataaattatggcatagataagtgatggcatgctatcttataggattggaaagtaggactgggcccatttttaagaaggcatttagcaggttttctataatcctttctctcaaatgttaattttgtcttcaaattttcaaagttttgttggcacagattctctagaaaatggggtctagaaaatagggtctatacctgaatttaaatagaatgacccaagtctgacaaaaccagacttgggtcattctcaaataaggccaacggctcatctcaatcagtataatttctacctgagaaccctcggcttgagaaggacctagactcataggaggtctgctactgaaatcttttggggggctacacaaatgggaaatctagacattgggattgtccttgtttttcaaattaaaaatatccacgaagtgcctgcagggtgaataccttgtctgtctccaatatcctggaatcccagcaacagctccccatttccactttaatgtgcatttccaatgtacacgtgaagacccatgtacattgcacacacgtccggaggaattcagcgattttgagtttctgtttagaatgatgttgccataacatgattatatgacatcagggttttatcacgcaataatatgcattattggccaatatttcctttcttattcccaaatgtcttatcaatactcccttgtggtatccatgttattagacgctcattgtacaaattcctcacagtaatggggacttatcctcactgatgctcacattaattcaaaactcaaaaagacacaaactgctaagtttttggtgaataaggcagggatgctttggagatcggtccaagaatcttaagagcattcttacgtaactctgtaacttttgaaatatattttggagtgaaatacaattggttaacagtgactggagagaaggtgataaaaggatatcctttactatctggctgttgcttgtgtctcaagttaagaaaacacatacagaaaagcactgaattggaaatcaaaagacatggattaattagtgtttgctctgccaatgtagctgtaagacattgtgcatgtctcttggcctcttcaaatctcagtctccctatctataaaatgatggagtttcattagctgattgctaaaggactttcctatcacagagtctatggtttcctaacatcttcattctgcagatcatggtgagggttatccctagttttctgatgtctatgctcatggcctcactattagcctaactgattaaaggcataagcttctgaaattgtatgaccagacttgcctttattatctcattctcaaatacttccatatttgattcctttccaagattcttttaattcgtggttatctcattgaacttacttaggccaaaaacaagacacaagagaagcaactgacacattttactccataggtgaaggttttgtgcccacacagatgatggatgggtgggaaacaatgtcatttgatgtccactgaaggaattttaaatgcttactctagacaggagtacttgaaaactgcttttacatgtataaagagctttcatacttgcaaagaatttggtgtggctgtgtagcccgaagaagtttaatctaggaacaagcagtagaaaatagattttggtatggcctaaagaaaagctttctaatagggcagcctgatgaaataagctgccttgagatataacgagcactctgtcagtggaggtactcaaaccataggctagacaaccacttggtagtgatgcagccaaaggtacttagcctacactactggctcatctttgaggccccttcaaactctaaaattctatgggccaatttactccctcactcccttttctcaccttcccagataaaaactgctcccttatctgtgtgatgctctcatattctaaatactttgacacattgtattctgtggtgatgtgttaggtgacttgtgcatgtagccacatctaaaaacacagaatgcaaatgtgccctaaatgaattcccaacctacgaggtttaatcttcaacatggcattgctgggtttgtaaactgttgagcttctttaataatatttctttatgctttggtcacaattcaatttttagatgcctaggatggaaaggttttattattatgactttttcttagaatcttaaaacattagttgccacagcatcctgaggaaaaagatgctgctgtgaagaaaaatgcaaattgcttgcttgtggaatatagtgagtcagtagcagatgaacaggcataatttaatttcacagggctagaaaatatggaatggaaatagaaactagaaatgctttactcttcctaaatgatgatttctacttctccctgtcccagattaaggtcttaccaagtcagagtggcagtatgagagcaggtgagcagtagaaaatagtgaagccaagacaggttagcagagagggttggctccaaataaatgagctattgtaggagctgaagatgagcaaaagatcacacaaactggtgggcagagccagatgggaggctttaagaccacacagatatctatatagtgcttatgtttgcacagactcactatggaaggatctgaaagaaggtaatcatagcagctgcctctggaggagggaactaaggaacacaggattagttaggacaggcgggccttacattccactgaatatacttctgttttatttgcatttttatcatgtaggtcttaccttaacaaaaaaaagaacctatcaaaagaagacaagttagtaactgtgaagagtgaaaatgtcgaaggaacagcacaagatgctcaacagccagaaaataagcaagactgccctgacctaagcaaacaagacaggccagagaacaaagtaaggcccttgatcttgaccctgaccctgagagcagtgctgtccaaatcacaggtacctgtattagtttgcttctcaccttgctgtgaattagtcctgagcaaacctgatctagacacccacagataaaaatgaaaatacctgggtgggtagaaggtgagctagggagtgcagggggttttcttggtagagggactgctttgataatcaggtttcttagtgcacattaagcatgtgttcttataagagatttgatgaaattttctaaaatctacacaatgataggcatttaaagagtgatggtcacttatgtcccaaatcataactctaccttactttggtgacagatatatataatatatataatatatatattatatatattatatatattataatagtatatatattatatatattatatatattataatagtatatatattatatatattatattattatatcatatattatattatatattattatatatgatatatattatatattattatatatgatatatattatatatcatatatgatatattatattatatcatatatgatataaaatatataattatatataatatattatatcatatatgatatataatatataattatatattatatatcatatattatatataatatattaaatatattatatataacatattattatatatattaaatatattatatataacatattattatatatattaaatatattatatataatatattaaatatattatatataatatattaaatatattatattatatataatatattattatatataatatatgatataataatatattattatatatatgatatattatatattattatatataatatatgatatattatatatcatatattatatattatatatgatatataatatattattatatatatcaaatatattatattatatataacatatattatatataatattaaatatattatattatatataatatattattatatataatatattacagatatctatataatattgaatctatattgaatatttcaatatagataatattcacatatattgaatcagattcacttatcaccttgaaaatgcaaaacccaaacttgaacaggcttgtgttcaggcttgaacgaaatgttaaaagtcataaagttcaatctcatcagacgtttaaaccccctctatggcttccctgccaggtaagtggtcagttcactacttgaactcttccagtgacaaggaactcactaccaaatgaactagcccaccgaagtcgtggatagcatagtcattagaaggttttcccttgtgttgagccaataatctgacttgcaggcatttcaatccgttagtgttgattctgttctcaggagattacagaaccagactgttctttgccctacatgtcaacccttcaaatctttgcaagttgctataatggtccccagactcctctcataatattaaagtaaattatctccagttatttccactgttctctatacaaccaggttacaaagtcatccacatcctggtaactttctgaatggactctcatttgtctaggtgccttgtatgacaggaacacaagtaagaagtaaacagaacaggtgtgtgcaggtatggaccactgcttcttgtactctaggcactagccttcagtaaggtggtttgaggtcactcagtcttttggagcagcaacatcaacctgttaggtactgctggtctttctatcaattgaaaccctgaaggcttcctcctacctggtgctattaaagcagatcactcttgcgtggttcattggggtttgaaacccacatttccctgttacatttcatcctcttgggtttggtttactgttactttctgacagccaatgactgtgtgagccgatgccttcacttggctgcccagctcccccatctgtgaatctcctcacaggccatcggtggtctctccatgtcactcttgacagtgctgaacaggtcagaggaagggatggtgtgctgagcaccagcaccagcagcctctctctgaggacattagtctagccatcagcatcggtcactgtaggttcaaaaagggcacatttctctaccttttccttagtagatgagaaaagcctttgaattttagaaatcttctttgcaaatacaaggtactcatattcttttaactcatatttactttttacttttcaccaaggacataataatccttgaaaacatttgcttattttatacttgtctgaagaaagtaaacaatcttttattgtaaggtggagccatttcttcatacataaatatttactgagtgtctccctatgtaccaggcaccagtctaggagctgaagataaacaatgaagaaaggcaacattccctgccctcctggcatgtacactctagcggggctcagggtccagatgaatgttcttgatgtaccaagaatatgctaatgagttaatgtttctcttcaaagtgcaatctaaacaaacaattcggtccctcctgaaagaagacttactgcctaggagggttctgaatcttgttcatcttcaaggagctccacagagttttgtggttcaattcagttcagtgagtatctgggaggtgcctgtgtgtagccagcatgatacttgatgctgtcagagacaacagggacctagtaagatgactgtctctatcttttctagtaaagctgaccatccaactggggaggcaagcctgcatttaggttcccaaacttagttacagaaatacaggatgaagaataacagacttgagagtatattacttcaaaaatgctcactgagggactttgaagaattcctcccctgctctgagacccatttccctcccacataaaatgaagggattatactggcagtggttctcagtggggatggtactgcccccttaggaggaatgaggaaatatatggggttggggttttttggtcatcagaatgactgaggggtgctactggaatctagttggtgggaacaaagtgtactacacatcttgcattgcacaggacaaacagtcccctgcaaggaagcatggtcccacctaaaattccaatagtgcctgatatggtttggctctgtgcccccacccaaatctcatgttgaagtgtaatccccagtgttacaggaagggcctggtgggaggtgattggatcatgggggtagtttgtaatgggttagcaccatcctcctagcactgtttgtttaaacatgtgtagcacctcacccaactcctgctggccatgtgaagatgtgcttgcttccccttcgctttctgccatgatggtaagtttcatgaggcctccctagaagcagaagcctgtacagcccgcagaaccgtgagccaattaaacatttctttataaatcacgcaatctcaggtatgtctttatagcagtgtgagaacgaactaatacagtgcccccactgagttgcgttggtagatcatccctctaagggcccttctatcattctgactttgtgacttagggactttacctcatcacaagacatgatagggctgtcaaactaccaatacaaccttggactactttgttaaccggagacccatgttttttttggaaccaccagcatcatgatcacctgtgatgtttgttaaaatacagagttcctggtcctacatattgaaaccggatctctgtaggtaaggcccaggattgtggattctagtgcccattaaagtttgagggtttacataaagagaaagctggtcctgccctccttgacactgatgagaacagtgctggattccaacttcactacccttatgaccctgtaaatgaaatgtgcccaaaaccctccaaaatatcctgaagcttacatcctgttgtctgtctctcctaaactttcctcatcagggttctttaacattccattttgctgtttttcctcctgcttctctcacttctcctcagttttcttcattgacttctcttttcatcctatgccctaaaatagcagttctcggtccgggcgcggtagctcatgcctgtaatcccagcactttgggaggccaaggcgggtggatcacgaggtcaggagatcgagactatccttgccaacacggtgaaaccccgtctctactaaaaaaaatacaaacaattagccgggcgtggtggtgggcgcctgtagtcccagctactcgggaggctgaggcaggagaacagcgtgaacccgggaggtggagcctgcagtgagctgagattgcaccactgcactccagcctgggcgacagagcgagactctgtctcaaaaaaaaaaaaaaaaaaaaaatagcagttctcaggttgtgttcaggccctgggctattcattcataacccttgccattgaagagcttagtgttatcttgaatgatttatgactagcatactttaatcatacatgaaattcacagagagaaaaacataattaaacatttacagacaataaatgcttaaatgctatgggaggtcaaaataagagatactgtcatgtcacaagccacccaaatatactactgtatcctcttagaagaaagaaccaggagtaaaggtggcagatgaaggtaggatccagaggaatgtgtgggaaagctccttcataacactgcccaggacagcaaagctataacttctgctaaaagtctcctctctgaaatattgtcaaactctttcgcattttccttctatcctggcactgagccacggttggagggaaaaggtagaactgcagccatagtgaagtcattgtgccagaagccatgggacccagattctccaagtgagggagtcaggtagtcatgtcattggagtccagaagctctgataacggtgtggtcaaggccagccctggaagcaagccactatccccatctaggaaaagtaccctaaagtaaataaggtactggagagaaagtaatcaataatgtcttctttgaatacaaaagtcaatacattgagatgggatatgggagggaactaccactttctcagcaattacatggtaggtactacacttaaaataaccctgtgatgtcacgatttttatccccatttttgcagatgagaaaattaggctcagaatgataaagctagcaaatacagaaatcctttcaaaatcaattatgtctagttccaaggactatacttttttgttgttgttctaaaaacttgggattactgggcacggtggctcatatctgtaatcccagcactttgagtggccaaggcaggaggatcgcttgagcccaggagttcgagaacagcctgagcaacatagagattctgtgttaacaaaaaataagaaagttatccaggcatggtagtacatgcctctagtcccaattacttgggtggctgaggtgggaggattgcttgaacccaggagatgaggctgcagtgagctgtgatggcaccactgtactccagcctgggtaacagagaccttgcctaaaaaaaaaacaaaaacaaaaacaaaacaaaacaaaaaactaaccaacaaccttgggatctggaaatcatattagggaaaagccaatattggaaggcaagtgaaccaggaaggatcaaggtagctgccagttaggttccccagaacatggcagaggacaacatgtgtctgctcaggacaggtctaggtcagaaaagccctagtcaagtactgccacaaattattccaaaggataggatatgatgggcagcaggaaacaggttcatctatcgatagggtcatgatagctaaagtcaaaggttaacagagaagaaggtcaaaacttgatatgtgaggtaccactttgcagccccccagatatcagactgaccaagggatgagaggaggctggcataacctggctggcagcaaaaaggatcgactggatccagatgtaggccctgtctccaatgtttattttttattttaatttttaagttccagggtacatgtgcaggatgtacaggtttgttacacacgtaaaagtgtgctatggtggtttgctgcatttatcaacacatcacctaggtattaagccccgcatccatcagctatttttcctaatgctctccctccctccaccccaatccactgtttcttaatggaaggcatcatggcccagcctggtaaaatcttagaagggctctaataaaaagataaatgacattctactgacataactttatccacatgttcaataaatataccaccaaaattcattcatgcacataaaaaacatttactgatatggtattatatgccaggcaccatgacaacaacagaaaagatggcacagtccctatcactacccatgtgactctgagtcaggcattattaggaacattcaatacatttttaacgattcgtttgatatctgccttcaccaccagactgggagatttactggtgtagggagcgactgtatcagtctgaatcaccccagtatctgtagctctctcagcaagaacctggtcaatagttgacattcccgttgcagatatgtctgctggattaacagtacatttttgggtggtgcttgggagtcaagaggaacgcatctaaattaaattgggatgagggtggtcaaaaagtttttttccaggaagaaggggctcctcatactgaattcaaaagaatgagcagcattagcaagaggaagaagagggggaacagcctcagcagatggaacaacaatgccaattgccagttctgactgaactagcctaaataagtactaatcacttagcaacccctgaattcattcaaacaattagattttaaccaatccgaatgaaaccagcagctgtgtgtagagacaggactacgcactgtgccctgtgcatgtgtgtttgccagcagagttggttgttgttctagtatgatatgtaatgctgagcaggaggtggggggcatcacaggaatcctccaagagagcacaaggcagcaacctcagactctcagcagcttagtcctcaaacggtattcactatactactcaataggctttctagtcacttcttcaaggtagcctctgcccctggactatttgctgaccagtctgctgcttgttccattggcatataatctcatcaagcagctctggctgtctgtgacacgttaaagttgtccatcaagtctctgctatttctttcattgagaggcagaatctgattaccttccccttgaatctgggttggtcctcagtgacttgcttgaccaagagaatgcagtggaagtgacattttgggactccagaggctgagtcataaaaggttgtacattttccacttggatcgctggaacactagcccttggggccctgagctgacacataagaagtccaaccaccctgaggtcaccatgctgttgaggccgtgtgtaggttctctggttgacagggccagctgagcctagccttcctgccatccttgccaaagcaccagacagacatgtgtgtgaaactggagagggggatacagagaggaggttaccataccagcgcatttaccagctgagtgtcactgggtaatccgtgttgatcaaaagaatcaccaagatgagccctgcctgaatttctgaattgtgagctatagtaaaatggtttttacattaagcaactaagttttgagggtggtttatcacacagcaataagcaagtggaacactgtcttagtcaacattatatcaatggtgccggtgttgtgcctggcatgtagtcaagttgcagcataaattcactgactgaaggaatgagtactagagagaaggatacgaaaaagggacatcagggaaagacaaagatgatttccaagtggcagttgttatgtgttgatacaacttcatttacaatgagtagaattttttaagtaacatggtacctactctcagaaactaaccagagtagacatttaaattgtcctggagggggtaaaaaagaaacaactgaatctttgtgctatgttgcctaccataaagtacagctgcccaatggctgtccctttgtcccagatcttaggatattccagctctcatgatctagacccagtccagctacaattaatatgcttttccttctcttcactgtaagacctctgcactttcctggaagtgattagttccaaaaaaaagccagcaagaaactatgaacaagaaaataattaccatgaatcttttcatcttattgataacaattttataaattagtttccaaggaataaagattattcttgctttaaaaaagaaaataattaccaaaatgaatgggctttcaagtttggcttcagaaccagacccactttctaaagtatacatacagactgtgcctcctgatggaaacacggagactttgattctaaatgtaactatgttttacttgcctcacctttaattgtatgaagttcagacctaaattcaatcagtagcctattgtttgttgcttcctgggaagcaagtagcagctgaaaggagagctggggaagaattgggtggggttggaaatctcaatcttggcacgactcttatgaattttcttttccattttactcacctccttctggctctgatgttatcagtaatttcccaagacagagaaaacccagacttcctcaaagagttcaactacctgcctcagcaaaatccaaaatggggagaccagctgctccatagaaactctgctcctgtgttcgtgtccaaggaaacttacagaaaggaaacacgctggcagggctctttcatttctgccttcctctagctggctaagaagcgaagtctgtggtgattctggacagcccatccaaaatctggaatggacaggacattcttgcagccagtgaatagacagcaaaggaaagagaaaatcaagccacttttgatgtattcaaagacatgagcaaaatggcaccaacaaaatggatgatgagctctgaaaaggacagcacataaaagcaaagttactttaattttcacattgagtctagggttgcagttgtctgacaacagttttcaaatggcacaaatgttacaagaccaaacctgactttttctaccttacactgctcacctgaattcctctggttcctccgaaaccacatctctgagtttctgctaagcttttgagagttttgagatgaaaagccaatgactttcttattcaagtactagaaggaaatattgtatagctttacagatgcaaaatgtagatacagatcaagaatcagtgtacttgggctctagttctgcttatgctgttaactgactgtgttatcctagactattcatttcccttctctaggcttaagttttctcatctgcaaaatgaagagcatggacagacagtgtgtaagggctctaaatggcaaatataatgaaatactcattatccaaggctcattttcacaagtgtagcttctctgtgggtcgccttggtttcaaacttatggataacaacacttttgatgaatgccttccctgttaaattaaggctttgctgccatttcaacatcttcttaacttcgtattcagaactactcttggaaatccatacacttaactacctcccatgttgtgaaggaaatcttagagggcaatgattaagagaactaaaaaatgaggggcatatatccagaattaagcacaaaaatcagtcatcaaataatagtgccattgtgttaagtggccaccatatgtgaagactttacatggatcattctaacccttatgacagcaataaaggtaataaagcattaagttgttggtgagagccagacactgtatttgacactctgaaatacatgatctctgacagaaaatgctgcatagcacttgctacctgccaggccttgttttaagtgcttcctgtatattaatttccttagtacccacactgacctcatgaggaaaaggtattattaatctcattctacagatgaggaaaccaaggcacagaaaggttaagtaacttgaccaaggacgtacaagttaatagataacagagctaggaatcaaatctagaaagtctgttccatacaaccctacaagaaagataatgtcctataactgtagggatgcttttcagctgtggattagctgacaaatcaaccacaaaaccccaatggcctaacacaacaatggtttacttctcactcatgctacatgttgcctgcaagtttatgagtgtctatgttccatatagtcacttagggacccttgattgatggaagttccaccatggagattgttccccattgcctcagcaggggtaagagagcacacagagattgcacacttgcttttttctacttcagccccaaagtgtcacaggtaattttccctcacagctcattggccagacctaatcatatgatcccacctaactataggaagcttggaaattagtctttcatgctttcagaaggagagaatcagatggtagtaaatactagttatgtctatgcaaactgcatttatcaaaacatccaactaaatgttcagctacatatgtaatggaaaatagtattcttttagcaagggaaaagaaaacggctaggatagataactagcagtgtccatcatataccctaatcttaagatgaagaatgtgagacttagagaggtttagtaatggattaaaggtcatatagtaagaaagtagtacactcaaatttgaaccctggtctgactccaaagtctataatccttttgctccagcaaactgcctcccaaagacaggaagaaattgttttgtgatcatccaccactcagaattatccacaatggtccacaaagtctataaaagagaacttagagctagagctggctactgaccactgctgcatcatataaaaccagagatgtcagaacaggaaggagttcttacatgacagaccagaccacctatcgccaccttagtacttttcagatatggaaactgaggcccatgatgtggagtatgttgttcaagaatacatggatgataatgagacagtgctaccataacatttgtatcaagcagggtcttggcaggaaacacagcacattcaaaaggtgtaactgaaggtaggggcagggttaagggaacctataaggtaaggtgcattggtcctggatcagtagcaggaagaaaccactaccatctctcgacctgaagtgagaaggagagtaatggttaccagaacctggtaaaagctgaggctgtcagagagggacaacccaacacaagctatggcatgaaatagtggaacacagccactgccaaatgtgacctggcagagaagaagctggagaagtaaatactgagatctggctttcctctcaaccctctgatcctttctccctcccccactgatacgttgcattgtcaaacctaactggaagccagaggacaagggagcctggttgatgcagcccatagaagtcagtctccaggggcccagagcagggtaaggaagggtagagagtgcagctggagtgggaaactcaagagtatccattatggtgactttcctttcttttcactgattcattcatttatttatttaccatgcatagtgtcagaaagtgctaaacacattttaatttccatcaacattcaagttttgtctttaaaatttggtggtgaaagcatgtcatctatccaagtataaggctagttttatttcaaagaacaggggtagattttaaggccatgctcagtttagcatgaggtaaagaaaactacatttaaaaaattctaccacagcttgacttctggttaaacatggcagactgataacacatgattatctctctccctcccgaagtctcattaatggaattaaaacaatgcaaataaaaagtgtgtgtgtgtgtgtgtgtgtgtgtgtgtgtgagagagagagagagagagagagagagagaagagaaagacagagagaaagaggtgttaagtccacgcagactaagaaaacagggaaggagacattagtggacaagaattatccataaatgtttcgaagacaggaaatgatgggaagaacgaatatttatttcagagagtaaaggaaaagcaagttagaacctaagtgcttgcagaaagacatgccaatgaaaagtgaaacaattagtccccattgaatcctgggaaggcttaagggtttagaaataccaagtaccacagaaattgggataagacacaggaaaacaggaattaaaactctgtatagggagcagcaggctcccatatatacttttcagcatgcagctacctagataactattttatcctctccctttgtccccaggaaacaagagagttccactcttcaatatgaatagacagccaaggatcacaaaacatttgaggaactcttccaatatgagagaagtcaaaacaaacaaacagagaaaacagagatgatacaataacagaagaaaacttaaaactataattaatatcctcagagataagagaaaatttatatccataagcataagcaggatactacaaaaaggaagacacagaaaacaaaggaatttaaggacactgaaaatatgataatcaaactgcaaaaaagtaaaaggattaaaataagaaaatctcccaaaaagaagaacataaagaccaagagaggaaaagacaagaaaagcagaggaacaatatgggaggtctaatatccaaataattgaaatttcagaaagaaaaaacgaaggggagaaaattatcaaagtcataatgtaagaaaaataaggacataaatttccacatttaaagctcctaaggaaggatcagtaaaatgaatgcataaagatctataccaagtcacactgtcaaaacatgtctgaattataagggctaaaaaaaaaaagaacctaaaaggtttcagagcaaaggaaaaaaacaatgcttatacggaagactcttataccagaactagattggcatcagccttttaaataacaacactgaaaacgaggagacaatggagcaatgccttcaaaattctgcgaaaaaccaattcataattttatacgcaacacagctatttatttcctttggcaaaaatataattttacctgtggaaggattatttttattttccaggcttattgacatcaagcttggccataagacttgattttccaatgacatgtgaacagaagtgatgtgtaccacttcagagcagcagctttgacagccaacactgattcaatcagtgctatttttcctctgccatgagaactgcttctcctagagaggggctgctcccttaacctaggtgccagagtgaaaaagacctggctagaactactgctaacccatgaaagacataggataccagtaagaaagaaatcttgtataagccattgggattttggaatcatttgcaccacggcatagcctactaaaaagctgactaatataatttgtcataaacctttatttaggaagctattaaagcacgtgctccagcaaaacaagtaagcaaataatttttaaaaaggagacaaaagacccaaaaactagggtcctaatacaggaaactggcaaagggaggatgattcctgtacagaaggcccagagagccaaggctgaagcgggaggctggaagactccaagaaaaaataaaattggtaggttatctgatatatttcagtgttcaaaaaataatactgaggactacttgataaatctgatgaatgttgtgcagaaaataagaaatgagtaaaaagaaaactaagcaaataagaaattaggcaattattgactctggggaaaataaaatattattcaaaaaaggaagtgaaagcataatgcattgcttggcttggcactggacataaatgcaaagctataataacaaacactgaataccaattttgaaaaaatacatgatttacttatactggagtaatggaggaaagaaaatggagaggctgtatggtcatcattagggctgttcacaaatattccagagcatcttttcccaggcacatggtagggttgtacttccaggcctcttttcagattaagtatagtcatgtagcttgctttgaccaataaaatgtgagtaaaattaatttatatcatacctgggaagaagttttgagaggcagcaggcaattaactctttatttgcccatttcatagatcatgtgatcaggtgttgagttggagcctccatcatcccatgtccatccttcagtgaccaacatgagccagaggccccctgcccacttaagttgaatgtgtagcatgagcaagaaataaacttctgttctgtaaagcccctggtaactaggaatgtcttgttatgcagcacagaccagccatactcgactgatagggactatgagacagccagcctctcatctatcatcacaagaagtaaacacacaatatctaaaataatgaatcaagtaatggcagcataagcatattacataaaatatgaaggtaagtaccaaaagcaagaggagcaggattgggaggaagcagtaccggcctgattggttttgttgatgttattataagcctgattacaaaaattattcatattattgcattgataaaaataattttaaacccatatatatatgcatatatatatgcacattttactggagatccagtataaggaataagagattggtagcagcaaggttttagtatgaatttcctcaccaatgctcaggattcctaatggagaagacagggtctagccttcattgtttttaatagaggaactcaactatctcttgacccttaagacaggttcctttcgattaaacattaactctagatattttgtagaactttatcctccaggatcaacattccctaaacagcaatgctaaaaacagtagaaatggataaatcaagacagcttttatactaagtaattagggatactttagaaccagtttgtgagaaggacttggagattgtattatttttaaaaattacattgaatccaagaaaacacacatttttccaagggctaaacagaaaaaaagacagctatgtcacaatagaacacctgcccaagtagaccctggcacctccatccagagatttttcttccttagagagtttctctactcatgtttggaaggatttatgctgtactatttttttttttttaagacagagtttcgctcttgttgtccaggctggagtgcaatggcatgatcttggctcactgcaacctccgcttcccgggttcaagcgattctattgcctcagcctcccgagtagctgagattacaggtgcctgccaccatgcccagctaattttttgtatttttagtagagacggggtttcaccatgttggctaggctggtcttgaactcctgacctcaggtaatccgcccaccttggcctcccaaagtgctgggattacaggtgtgagccacagcgcccagccctgctgtacttttttaaaggagcaatacctttcacaccccaatagcaaaaaaggaagagcagtctatgaaagacccatgcatcttacagcaaagcaacatagatatgaagcaacatgaatgacagcccacagtgaaggtgaaacaacatcaggaaagaggacctctggcaaaatctgtgtttccatgtggactgccacatcaatccaaccatgctccctgttataatcatagtgtgcatttggaagatggtgggttggggacaaggatatacttgtggctatgggccagagggtaatgatacatgtgcctggatgagggtgcactgtaaccaatagctcctatcatccccagtgtgttcctaaatggtctgacctctggctgctcttacaagcctagtaagcacttgattatggctgcctgtgaattgaaatcatataaataagccaaatcagccctttatatccgaatcagacgtgaggttgccatgcttacttttaaatatgaatggctgtgtgttctgggacatcccaatatttcaaggcaataatgaaatcaaactataaatttctggctggggagcagcaaaactatccagctcttctatccctccttcccaagccttcctcaaaaatcaagtcctctctcttccctgagctaaagatacatcacatacatctcagactgatgcaaagctctggccaccagccatgctggatgctctaacctctgacacacactgtccctaaggctaaggatcactatttcagcttcaataactttttcttctacctcctgctactctacaaaaaagttctaagaatgtagacagaatcactaccttggacccaacatcttgagttcaagggataccaacataatcttctaaaagctaaaaatctcagttcttcaaaatgtgacctgaatctacctttacatcttgtctctagtcattttctgccaatatccatattactacataagtgattccctgaacaaaccacgcatttatctgttctcaatctctgttcatgccagtgccctgacctgaaattttctatccagatcgttaggtatcagagttagctgttgatgtgtctctctctttcctactagactgtgagacaatctgagaacaggcgctgtgcctttctcatctgtgcatccccagcatccagctcagcacctagcccataggaaaaatatgtgctaaataaatcttaaaaggcaccacaaaccatttgctgatttcttacagtaacaaatgcaccaactaaaacataccattccctgcaatgcttcaaatggccaaaggcctacataccccatatatgagctcaaaaacaacaacaacaaaaaggcaaagaactaaactgagatgatcttagattccatcttcaaaaacaaaaacaaaacaagacccaaagaaacttcatttctgcaaatactactttagtgtgactggaagaaaagcccatggaagacttctaactgaaacaaaagtgcaacgtatggttctgggccctccatgtgttctgagcctggaacaaatgactttgctctagataggattctgtttgtcaactgggcattgagaaattagaaatgtggcaggagaacatagccagctgttcttaattaatgggtctgtgatgcttatgttgaaatgaacacagaataagaataaatgaaatataccttaatccaacaacacaaaaggggaaaggggaaaagcaggaaagccccactgaaggatggtccaggtaccaactaaaagatcaaataccacaccagcatggcacatgtatacatatgtaactaacctgcacattgtgcacatgtgccctaaaacttaaagtataataataataaataataataataataatttaagaatgttaaaaaaaaagatcaaataccaacattcactttacctacagggcattaatgctacaatacccttgtaccctcatgaactagtttaagggcttaagcctaatagatgtcatcaagaattttaaaattaggtataatgtggacaatctataaatgatagagaatgggttattttgtacagaccaaataccactctactttaaaggtcacccaaaagtctgctgacatgtacctttaagcaccatttttattaaaaagcctgaaagtctgaaggaaaaaaatggcatctccaatcctatatagaaagcagagggaggtaggggtagaaaaacaagtgtaagagggagggacagggggttgacagcagtcaataatgatttatgtaattggacttgtctggcctactcaaagaccttgaagtaaacatagccaccagctgacagaagcagtagcaattcaagtccatttgccagaagggcaaggacaaatcctatggagaaagaaaggagcatcactttggagctctgtgaagtgacctgggcacagtggatattaagaaaacaaaaaaggagaaaactgtttttaagagctacatgaaagtacctttttagttatcacaataccctgtgatgaaggtggaaggtgtgtggaaaacaatcaataaccttccctaatagctttttgggaaaacggcggtaatacttttttggcttctcctcagccatgtactgatgacatatggcatctctgaattcctcccactgacaatttgccctgaagagtctctcatactgaactacagaggagagaggaaaaaatttcaaaaaactaaagcagccaatttttgctgaaaaatctggacagttagctgtttggtatctgatagcattttatttcataggagactagtgaatccccttgtggcttctttggttaatacttcccgaagaggagaggcaggaatttcaagttcaactcaaagtgaacagtgagatgtccatagctccctatgtatgtgtaactgggctatgggataaaataggctattttccattctttgcaacagaacttttatagcaatggttgggatttccaagacttcaatgtaagaagagcagaaaaagaataatgagcacagatcaagaagaatcagaacttggagagccccagagttgtccctaagagggctgactggctatccaagttacaaagatgaaaaaatcatgataaatgcaagctgaacaatctggctaggaaagaccttgcacagtggcaatactaatcttggaaacatggtgctgccaccctgcaccttacatacggcggcagcaccatatttctaagacattttatttgaattgaatgttagttggcagtttggtggagaaacagagtccaacaccccagggaaaaacctagcaatggctaggctggatgccagatccccacccaagcaggacagccaccagttcagtcctggaacacatcctggtttcacccacaccataatgtaaaaagaaaagctgcagattagtgagtctccatgggccccaggggttcttctcaggggcacttaacacttaaggtatcagactaatctagaattaattacctactatgtgtaggtacttctactatcccgtcaagcttagttacctaccaatgcttgaggtactaagagacactaagtttgccagctgctggcctttagtgtctactcctgattggggctgggacagccagagtctgacaatcgggtgacaggactggaatgcagggtctatcttaccatggtactctgccaagagtcatcaatccactggtgcaggaatccagtgccatataaggaaatggaattcagcctttggttcagtgacccagagtactagctcatattgtatcaatatctaaatgataccagtttatagaaacctagcattaacatttcagtgtcagtggcctcatagagagcttcaacatatgtaccagatggattcgctctcttagatttagttcccttctctcagaaaactcctgcaacaccaaaggaataattactgctcagtgaaatactgcagagttctagccaaaaaatagtcacatcaatttaaaccagcaaatatgaatttttggaagagaaaagaagcctctttccagaggcaattatttgtctcttcagaaatatttgccaatataaaatctccgtcccaaatctgtggaactcaaaaatgagaatcacagcagtgtatctgcatggaagaggctggaaggtgtcaggaagaggggcagatatggctttgcacagaaccttgtatgttgctgtgacctgaaagctgcagtgctaaggagagggcaacctaaatctaaaactcaagtgcaggtgaagacacactcacaaaggaaagacaacaaatggcagaatgatcatcatttcttcatgcacggacttgacaggctgcaaagcacttttccatccattgtctcactagagccacccaacacctccgcaaggtaggcaggacaaggactgttagacccattttacagaggaagaggtggggtgtgggagctgggacagcaatctgttgatcttcatttcagacttgcctctgtcccacaaccgtggcatcatacaggtggtggtggacacaaaatggcatattttgcccctccaacagccacggcatcccaaccacaccagacactgctctcaattcttcgagaaaagtggcccgtttcttaggtttgaaggaagttgttcaaagccctccacagccacatccacctgtcttctacggaggctagtagctaatctaatcaaattgttattaggcactacaggaggcaccttcgctgtataccttctacagataagtcaatgtatacgtctctagctaccaaagactttgcttataacagttcacactgattccctcttaaagcagtaatggtcccaccaccataacttccgcacactccaaagagccaccaagaccctggctgctggccagtacctcagggagctatgaatcactcccactcaaatcttcatccccttgaatatttgggacacctttcaacagtatcactcttagactgggacaaccagatcctgccctaggcctcatggttggcagggccttactctggccctgctgcagccacactcctcacagggcaaggggtatagagggccaaggggtcttgccaaccccaagtctatgcttccctcttagaggctatcctcaggatacccatgaccttgaaatcctctgcccatgtgcctcaagcctgcctttggagcctgtgtgatcctctttcctagttctgtcttcctaaggatggactaaaccctaggcctgaagagtgactgaggggtggccacagggcagctgttgcccctccactcagtgttgatggagcttgaacacgtgggctatggcagtgcttctcaaaatttaatgtgcatgtgaattacctagcatcttattaaaatccagattctggttcagcaggcctagagtggggcctgagagtccacagttctaacaagctctcaggtaatgctgatgctgcggactggggtccacactttgagaagcaaggctcctcaaatataatgtgtggaagtcctcttaggggaaggaacagagcgagaaggttgaagagaagtgggaatttgcagtgagtctgtattttgcacccttgccccaggccaccaaagtcaggagtggccttacctttcatcatgccaaggagaagtattaaaagtatgctgtccctgggcaacaaagaaagacagtcaagtgggagacaccatttgtccaatttgtccctgcttcaaagcctatatatccctcccacgatcacctcccatgccagaaactggaacactacctcctgagacccttcacaatgacatgtcatcaatgttcaatacaactgcgcccttccacggacatttacatggtgttttactactccgctacaatgtttggttctcagaaagaatacattccaccttgcgtgtcggtagtcagcatcagacactgaacaataacacctcctaccaagcaatcattcatacgccctggcctgagaaggagggttgggaccctttatgtggacctgacacacccatactaacacatagccaagaatccataaaaccccagtcttaggcactggtacactaactagtcacagaaaatctatattcaaattaccaaacccacatgagcaagcctggattttttcctgtcttttattattgtaaagagaaaggttaaaataaaaataaacacaaaaccacaaaaatattgtttaattggaatattcaacttggagagcaaactagctaatgtattcctgaggcacagtcatttttaaaacttttacaacatagaatcacctatttaaatccaatggtagtgtaagtccatataaaacagatacaaacacagctgtctggctgaaacgggggttgccagcccagggccctgttcacttggcacctcaatgagtgatacatataagaggccccaaggcaactccaagaaagccctggtgctctaaggtaccccatttgaaaatcaccactaaagcatatgtcactttattatgtcctggatttttcccatcttttattattgtaaagagaagggtaaaaataaaaataaacacaaaaccacaaaaatatggtttaattggaatattcaacttggggagcaaaccagctaatgggttcctttctttctaatcacactgattagcactcaggcttaagagaagcaaaaaatgatcagatgaaggaagtcatgccacggtcatgtgggggatgggtcacagagctgccaaatgttttaacaatgcatctaaatgaagcctcatgatcacttgagtaatacagagaactgggtctgagtcctacttccacagctaactggccttgtgatgttaaataaagcccttcccttctctcagcctcagacataggatccagactggctttgcccagccctgacgctctgggattttatgatattccagaattccatatttaagtgaagaatcatggtcacatcgtccatcacagatagatgctagaggaaaataaaggaaacctttatgttgttcctgctggcatgtttccatgctttccttcagaagcttgaagcattttaataacttattccattggattcacagcagaaaaacaaaaaggaaattaatcttgaagaaatcatatgtctctgcaatctttgaatatatgttagtaaggttccagctacttctgcacactggcagcccttactgacttctggatccagaaagagagagagaacagcatttgcctgtttggaaggagggaggtggtctttagggaataagatcagggagtcagggaggaggaagaagcatttgcagtagtctagatagagataagataatgaggacctgaaccaaggccacatcaatggaggtagaaagaaaaagacagacgcgagagacatttaggagaacaaactgacaggactgtgcgctgactgatgttccagaggagggagggggagatggcatacatgatggtgccactatccaagttatgactgaggagaaaaaagatttgagaggcaagaagacagattataggttggaatgttgactgtgagatgtctggggtcatcgggtagaaatgtccagcaagcctttggttatactggtataaagtcacacaggcctaggcaagtcaaatgtaaccacaagattaacttggaagtcctcagcatatagggcctctgcctccttataattataccacattgcctcatttattcattaaactacttaaagtccctcccaaaaaatatttacagtccctatttactttgctacgcaaaaggatatatgggttaatatttgaggtggtggatatgttaattagcttgatttaatcattccacattgtcttcataaatcataacatcactttgtaccccataaatatatgtaactacaatttgttaatttacaattaaaaaataaaaattttttaaaataataaataaaatataggcatggtctctgtccttgtatagcttacattctagtgggggagacaagtttttttaaaaaatacaagtataattttaaattgtgataaatactatggagaagacaaataggtacagtgatcaagaatactagggggaaaaagagagacttatctgaaaaggcctttaaaccaaggtttgaagggcattcctggacaaggcaacagactacgtgaagacctagaggcaggaagaatttagtcacaaggctgggagacccattaccttggtctctgtgctatgcctagaatacttgctgctgctgttactgacatttaaatgatagtggctgggcgcggcggctcacacctgtaatcccagcactttggaaggccgaggcgggcggatcacaaggtcaggagttcaagaccagtctggtcaacatggtgaaaccccgtctctactaaaaatacaaaaattagctgggcatggtggtgtgtgtctgtaatcccagctactcgggaggctgaggcaggagaattgctcgaaccaggacctgggaggtggaggttgcagtgagctgagattgcaccacagcactccagcctgggctacagaatgagactccgtctcaaaaaaaaaaaaaaaaaaaaaagatagtaatgaagtactacaataagaataagacatgatcataaaattataccaaagccaaagcacttaatgcctatgaaatggtgtttaacagttttatattgtcactgatggggccggatacagatggttacattagttggatataatattaactaggcaaaactttaaataaaattgctacagagatctgcattccattaccaatagctctgattgcctaaatcacactagcatactgaagccacactctgggcaaagccaccattctgtagagtttctgtcaaacactgttattgaggaagcaatacttaaaataacattccttttaatgattagagttggcacaaactgcaggacagaaaaaaattctatatagccactggggaaaggataagtaggttgtgttttgcaattccttcctggtgagtttacaattattccacagcatgacagctaaaatgcctaagaaatcacttacctgaatctcaataataattagtcccctattctttgtatgttcaccatgagttctgttgacctcaccacatggaaagattaagtttacccatttacagttctaagtatttattccttacaggcaaacaaaagtatgctggaggtttaacaatttctggccaacagtgtgtattttaactaggatgtttaagatgcatcggttgaataattaatgtataaatcttagccagctgggtaaggaaaatgaaacaagctttatttgttatagatatagatttagctatattaaagtctttctgcttttaagatgaagtctctatgtcaaaaaaaagccaaaatacagaaatactcctgttcgtagtgtaattaaaaaggaaattaacaaattgtgttaatttgctgtactcgtaatttggctgaagactgtggtgttgcagtattaccatttgggtgtaggaaagcatgcaaatgaatctaccagcacttatcaactcttcacttatttcctcatttgttaaactattcagaaacgtgtggcctgcctatagtaagctataattagggctacttttaataattaagggctatttttaaaattaacattttaaagtccactggtagcccttacatcttttgtctcacactggcaggaccaacagggtgccagttcagaagaagcaagaagcagcacttaattttactgtagccctcagcaaatgagccatgtgtgattttggcaaaggaggaaggtcacccagcttgctggtggtatgtgcgtcactagggggtctatcaactccatcagagtccctggaacacagtgaacctctggtttagtactggtatgtaagatattgcatctcagaggtcaaggagcacaactgttcaaccctattcaatttgcttcctgccatttccacaaatgctaaaaagttgactgtcttcaacactcctggctctaacgaagaagctggggaaaggattttactatttatagtttagttttgactctcagggttttcataggttcaactcaaatgtagtgcttagggtatatttatttttctcaagtcaaaaaagccaaatgccaaagccacagaattcttttctatgctttagaactcacaactgatagatgaactatacatctgtgcctccttgatcctcattgtatatatggggaaactgaggcaccaaacatttagatgacttgcctaatgtttcatggccaattagtggcagagcactggctaaaacccaagcctcttgccccctctcccacaaatctccatggagagctcttcccagcacactatatcacccccaccaaaagtgagactgctataaaatgtctggacatgagttgtatagggtaatttactgatacaaagaaagatccacagggttgtcagtgaatagacactcaggcttttaaagaatggcctgcttactgagctgctcagcctctccctggggtcagaccaaagtttaacaatgtgttgcattaagaaagatactgaggggtcccccacaaggtcggacaccatggctcaaccagggtttggctggcttagacttgttccttacaactgttacctctaaccctgacccaactgcctgtgatctggctcaagaccaacactctttggctcctcccttggttcatttttagattcttactctttcttcctccctcccagcttccatccctccataattcctctgttcttgaatcctctaccctacctgccccctcatcccaggattcaaagtccaggacgccacagctggagtactctctcccttggtgcactagttcttgtagatgagaaccagaagtgtggagtaaggtagggaaggcaagagtatttaaacatctttactttttcaaaaaatcaactagaaggttctatcaatttccttccacaagaaggaattgcaaaacacaacctacttatgctttcccaatggcaacctttttcatagatacagtacaatgaaaaaataatcaaaagctgaccaagggctttgcaaacatcttgaagggcctatggaagcatcaggaagatgaaattttattctaccataattaagactgaatgtactttcctaaattcttgacttttcaaaattgttcacctctatatggtttacagcaacttattccttgtagaatattttctaggtataaaatcactattatttggggctattgtttttgtgattttttcaaagagccaggaagacacctcaacaatcataaagataattcctcattaaatggcatgagtagagatctttcatttagcgaaataagctttctgtagggaaagttacccagaaaattagaacttgtttagcaaatgtgtgtcacatcagtgattggcaataaaataaacacaggaaagtataaattcaattcatgccatttctaaatttgtgataactcagtcatggctggcatatttcacctttcctctatcaattaaagaaagagctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtctaccatttgacccagccatcccattactgggtatatacccaaatgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataagaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaaaagaaagagcaacaacaggtttctgagtaaattaagagtataaacatgagctcttaggggatgtttaacccagttcagagaacaactctttccaagctctctaacaaattcatttgcatataaataattagtgtgctgatttcaaatgacctttacctactcattggagtatactcgatcaagacctctacttggcaatattttgttagctttttataatatcatttctgcttgaaaataagaaaaaaattattattttaaagagatctcattaaagaacattaagaaaatgtctgtccataaatgcctcatgcagtaagacatgaggcagtttgccccattattcagggtatataaaccaagtctccacttaggatccaaaatgcccagtactttaagagagtcaaagggaaagaccatgcgcttgtattgcttttacaatttaaaaaatctacttagtgtagaaaatttcagaaaataggtagataagtgttctagtaactcaaactctatctgagcctgaaaggtaactcagaggtcatgcaggatgacccaacccctgacaacaaaacgctcagcatatgcccagaaacctggcttttgcttaaggatatccagagcctcagagcttcccatctcccaaagctcttcccatcatccaacagtcaaagtattagtctttccttatattggaccaaatctgtctccccgtaattcctacatattggtccaagtttctaggggaaaaaaacaaaacaaacaaacaaacaacaacaacaacaaaaatgatgtttctatggttctttacacagcactttccacatacacattctcattggactatcttaataatcctgtgaagcagttattcctactacccttgtttcacagatgaagacctggaggctaagagaggctcaggaactactgacggttgcagagtggtgaagtgtcagaagcagggcttgaactcaggttttctaactccaccttttatagcattttcagtatcccttgttgcctcaaacattaaaaagagagagagagaaatacgctgcttctgcttccccatgggaacagcctttgaagtcgaaagggggtagaattattgaagatgcactctccacacattctctctgagagatgtcttactattcacttgggtttaaactgcccagacatagaggccttgacctgtatttccagcctagacacatcctgagttccagaacaaaatagctgctctcccctctggaagtcccacagtacctcaaattcagcaggttccaagctgaatttatccaatttttttgtacattctatctccactgttcattcctgaacttggtcaaaaataccaccatctactcagacagccatgccagaaacctggagaattaccttagacacttttctctccctcaccaatcctccccacaacatcgtaagagtttcaccattttgcatctgcctcttcctctctgtcctcactgctactgccttatacagtccaccatatctcttagatgaattcagtgaccttcaaaatggtctctaggcgtctagtagcatccctttcaaatctacctgcctccatgtagactgtcaccagagtgatgcaacagggcagtctatgtcactcattgcctccacatgtgactctcaaatctagctaactaagaaaatgcctaagttccccagatgatttcaataattcagcaatgtgtagtaactaatggtgtacaaagcaaagtctacgtactcaatgatctgaatctcacctacctctctaagtcatcatttctgccattttccccttggcaaggaatactccagcaatcctaaaaacataccatactggtttgcacctctgtgccctgactggggctgatctctcagcctagaatatctttacccttggccaatctccaatgaaccttcaaaacttaactgaggtgtcacttcttcaggtagtctttcacaacattatcagactggattaggtgcccctccgtatgactccacggcatcacacaaagttctctatcatgacacttagcatattgtgttgaaattatttgctcatattctgacaagcctataagctctcaaaaccaaggaacatgtttattcatcactgataagtacctgtcacttagtagatgcttagtaaatgttcacctgaaatggatctaatttcaagtgtaggctccatacttggctaactgtagagttgaattttaggaaactcaattcagctgcttagacctcagttcgccaaactgtaaaataggcacaataaatccccacgtttggccaggtgtggtggctcatgcctatgatcccagcactttgagaggctgaggcaggatgaccacttgaggccaggagttcaagacatgcccgggaaaccctgtctctacaaaaaaaaaaacagccaggcattagtgatggtgcatgcctttagtcctagctacttgggaggctgaagcattaggatcacttgagcccagaagttcaaggctgcagtgagctatgatcgcaccactgcactcctgcctgggcaagagtgagagacaccctgtctctctacaaagcaaaataaaacaaaaacctccatgttcattcatacactaaacatgtgattactaagggacaggcactagcttgtgtgaagatttaataaattgaataatgtatgtgagagtttttgtaaactctcacatagtattataaagatatttctgcaattttagcttctacttagtgtctcagccagaaataatttaattccctaaagccaaagttaactaagcttttagtctccattaggctcaccaaggtatcagaggaagaaagccacatgtgaacaaatatgaacctaaaagagtcaatccttcaagatggatcccaagtggctaactgggcctaaatttaaaatacagccaggcagccatttgctgactaaaggtcactctgagtttcccaaaaactcccacctctctttaactttgggactttcagagctcacctataccaaccaattagggcttagctgtatttaccaatcagaacttagctgcatcaaccaactagaactaagcccatttcaatatttcatttgcataaataaacctgattaggaactcaggcagaaacttttgctataaaacccaaacactctctttgttctctgaaacataacttccttttatacaaaaggctgtgtctcctgagttcgcaaactgttcactggaataaggtatctttcctccgaattcctttcagaaaacatttttttcacagccacttaactcaacaggaactacactggcctaaacgagactggaagtgcactctgggaaaggataacacagtaaaaagccactttggcagaggcagcgctaatttcctaaggacacaggcttcacaagtaagcactactgaggaaaggtcactgagctccaatccttctcctcactgacatctgccctaactcgtactcagatttccatagtaaagggtgtggatcctggtggagcaggcaaaactgagctaaaaagatgacttccaaagactcatccaggtcttcctggggcttgtctactcaggtgagtactgagtaccctgagattatcctggggaggtcactcccaggggcagttttaaagtttagtcccacagagctgaggggagccaaattgatttgtttgcccccaggaatttgagcccagagccccgcactgttctttacccaaaaacactgctatccctgagtgcttgtatcctgtaggcctagaagggaccataaaacttcccaaagtccttggactagaggttattgggcctgttcgaggctctcgccctctaccatagagttgctcattctcttggggtaagttctagtctgaagattgcttctcagaatcccaagctctgcaggcttctatcaataacaccatgtgacatcattcccaggccactaaaggaatctgatctctcattgctccaaaagtgactactaaagcaggagagccatcagaagttatatgccaagagccaagcgaggaagggctggaagcatttcctttacatacagagctcccagaaagtatgtaaatccacattcactgaagccggttcttatcgaccatcccttttggattccagccatgtgatcgtgtctacctccaagaaatctcagatggtggttcactaagtaaagaaggcaggaagaagcatctgagcagagggaacacattaaaagacagaagaatatttctggagtgacaagagacaaagctgaagaagtaggtagggagcagtacaatatgacaggctaaagagcttaaactatatcctttagaaaagtaagcagccaccagagagacagtaaatattgttgtacttgttcttattttgatttgttctttgcagtgaaatggcatgactaaattttcaatttagaaattcactttgtgtcagtagactgcacgaagcgggttggggggcatggtaagagactagacagaaaggcaagattgaaaatcactgaaatagtctaaatgagagatgataaaagcctggacaaagaagcagcatggggataaagacagaatattaaagagagttttagaatagtactgacttggtgaatatttggctttaggggagagggagaaaggaggaatgatggtcagatgtatgtcctgagaacccagatggatggtcatgccattgactggaaatatgacaagaggaacaagtttgggggcagctaaggtggggagagttaagtttggacatgtatccaattgcacatctattctacaaatgtccatctatccagttggacatctgtcctacagatagtttgatatatgtgtctgaagttctcagaatattccaaggctagaaatatttatttgggagttatgtgtgtaagtgatagttcatatcttaagactacatacaaatagccaagaaggaaggtaaacattgatttgtaaaagattgtggacggttggacacagtggctcatgcctataatcctagcactctggaaggccaaggcaggtggatcatttgagctcaggagttcagaagctcaagacaagcctaggcgacatggtgaaaccctttagctgggcatggtggtgtgcacctatggtactggctactcaggaggctgaggtgggaggatcacttgagcccaggaggtggaggttgcagtgagctgagatcttgcagataggtaatttaaggggcagataagaataacctgaaataaaacgatcaaagacaggagaaccagaagagtaagggatcaaaaaagtcagaagaggatagagatcaggaaggagagaatacaaagtaaagagaaaacatatgcaaaatattatgaaagtaatgtggaacttggcaacaaactgattccttcctatctcatttctcttacatgtaaatatgatgccaaattgaaagtctggatgattagaagaatagtctaatcattagaagattagttaatctatgattaacagaaataaggaacacagaggaagaataaattgattgggaggaaagatgatgaatttcagttgtgacacactgattctgcaattagggcattaatggctaagaaacagatgggaaactgcgacaatctcaggagaaaggtcaaagttggaagtaaatattggaaatcatctgcacaaagattttagtgaaatccatgaaattcccatggaaaagaatatcaaaagtgaagaggcaaagaagatatacaaatggtcaataagcacatgaaaatatgttcaatgtcatgagtcattatggaaatacaagtcaatcataatgagacaccagttcacacccactacaatggctataacaaaaaatactgataacaagcattggtgaggatatggagaaaacggaacccgtctacactgctagtgacaacgtaaaatgccactagcaatgtaggaggcatggcaatataaaatggtgcagccgctttggaaaagttgttcagttttttttttattttttttttaagagttaaacattgagttatcatatgactcagcagttctactgctgggtatctactcaagagaaatgacaacatatattcatataaaaacttctaccaggccgggcacggtgactcacgcctgtaatcccagcactttgggaggctgaggcaggtggatcgccttggtcgggtgttcgagaccagcctgaccaacatggagaaaccccgtctctactaaaaatacaaaattagccaggcatggtgacacatgcctgtgatcccagctacttgggaggctgaggcaggagaatcacggagattgcactccagcctgggcaacaagggcaaaactccgtttcaaaaaaaaaacttctaccaaatgttcataacaacattatttacaatagccaaaaggaagtaactcaagtgtccatcaagtgataaatgaataaacaaaatgtggtatatccatatgatggaatattagccataaaaagaaactggactttagtaaaattaaaccaaaaaccttatgctctgtgaaaggtactgttaagagaatgaaaacagaatccatagagtgtgagaaatattttcaaaacacatatctgataaaggatttgtatccactatacaaaaaaagaaaacaatcaatttaaaaatgggaaaaatatctaaacagacatcgcatcaaagaaaatgtatggatggcaaataagcatgtaaaaagatgctcaacatcgtatgttatcagagaattgcaaattaaaaccatgaactaccagtacaaacctatcagaatgacaaaaatccaaacaacttacaacaccaaatgatggcgaggatgtaaagcaacaggaactcttatacattgctggtcagaatgcaaaattacaaagccactttggaagccagtttggcagtttcttacaaagataaacatagtctatgctcactggtatttacctaaatcaggtgaaaacttatgtgcccacaaaaacctgcacacaaatgactgaagcagctttatccataattgccccaaattggaagtaaccaagacgttctttaaaaggtgaagggataaactgtggtaaatccatacaatagaatattacttagccataaaaagaaatgagccattaagccaaagaaagacagggaagaagcttacatgcatattacttagtgatagaagcctctgaaaagattacatgctatattattccaattatataacattctgggaaaggcaaatcaaaagatcagtggttggtaggtgttcacagggaggagggaaagactgccctaaaagtcccctgtgttttaccttttcatcaaaactactctgtatgatactgtaatggtagatatatgacattagacatttgtcaaaacccatagaactgtacaacacaaagaatgaacccaaatgtacggactttagttaatcataatgtgtcaatatcaattcattgattatgacaaatataccacaccaatgcaagatgtttgtgggcaaaattatggtcaggagtggagaggagggcagtataagggaattctctgtactatctgctcaattttctgtaaacttaaaactgctctaaaaagtagtctgttaatcaaaaacgaaaacttaaaaaagagagagaataaagtgctgctacatgctacagtatggatgaactctgaaaacgttacactaagtgaaagaaggctgccatagaagaccatacagtgtgtgattccatttatatgaaaggtccagaataggggaattctatggagatagaaagtagattagtggttatctaggacaagggggggaattaaggggaaatagagggtgactgctaatgggcatggggtttctttctggggttttcaaaatgttataaaatctattgtggtggttgtggtgatggtctagagctctgaatacactaaaaatcactttaaatgggtgacttgtatgcatatctcaataaaactgtaaagatggtaacgagtttgaaaatctcaataaaaaggacaattttctaggaaaattagctaactggaatcacaaagaagtagaaaacgtggggaaaaatagggtgttacacattttcctctgatgattgttacagtgcccagacagctttatgagcaagttctttttaatttacaaagaacaggtaatttccatgctctaaaagcggttctcattataaaataaaagaaggaataagcccattcattttataaaattaaagttatcctgatcacaaaacctgacgaacacccacacaaatacacagagaaagaaaactgaagactaatgtcacttaggaatatagatgcaaaaatcctaaatgaaatgccagcaagccaaatctggcaagacattatgagcaaggagggattatttcaggagtgcaatttactatcaggaagtctagacatataactcatcacaacaatcagttgaaggagaaaacctgaacaaatgacaagaaattaatatttcaaatttattttttaaatctattaataaacaaggaaaaacctataccaaaacataaaattgggcaaaaaagaaaaaaatagttcagttttacttgtaattaaataaatgttaattttaaaatatgataatcaattctttgtagtcaaattggcaaaatagtaatatcaagaatttgggaaaaaaaggatataccaatattctgcctctaagataaaaattgttataggaacatttagtaatacccatgaaaagccttaaaaattaacatacaggtgaaacaacagttgcacgtctaggaatttcttcacagggaacaatcaaggacttggaaaggtgtagtcacacactacttacctctgcattgtttatagtacagaaaaacagaaagtaactgaaatgtccagcattagaagattcatcaaacaaattctggtttgttcattcagtgaaatgccatgtaaccagtgaaggtaaaaaagaacaatgaacttaggtattctgaatacattcaataaaaaaagcttatgaaagagcatgtagaatacagagaaaagaaggctggatggttacaataaaatgttaatagtggctgtctctgagtgggaagaatacaagtaacttatatgctgttttttttgtatatctgtgattttgtacatgttctataataaacatatattactttggtaaagaaaaatataataagagtgtattttaatgtatatgttcttaactaagaagttttgctgctagaaatttatctttaaaatcagacatttacaagatttatgtataggaacacacattattataaaagcaaaaaaaggaaaccaactaaatgtctagcaatagcaattataaagtatgaaataactatggctatacaatggaatactaggcagctattaaaaatcatgaggtagaagaacatataatgacaaagaagattaagcaaaaaggcagattataaaatagtaaatacaaaatgaggctaatttttttctttcattttatacatttttaatttttttaatttttaattttgtgagtagttagtatgtatatatatatgtatatatatatggggtaaaatttttaaaaataaaaccatatggaaaaaatactggagggaaatataccaaaatgaacatcaattacagttctcccgaagccaaagaaccactggtaatttgtttattttcaccgttctgcatttcacaaactttccacaatagattttaaactctaaggcatttgaggagcaaggagcgagaaaaggtatacaaccatagtaattctctctgctgccattatactaggcatttatagtatcccataactgaatgcaagaattgctcctgtataaatgggaagaacatggattaaaacaaatgagaaaaggggcaatgtgctaatatgttgtctgcataattttttaaagcataaacataaatctggaaaccaacatattacaaggttaagaatggttacttcttgttggtaggaatgtgggtaatggttaattttgtgagtgtgattttttttttaatttctgaaaaataaaaaaataaaaattaaaaccaaatgagagacctataaatatttccactcactggtgttggggcagtgtgagtacacttcttcctctgtgtctgagactgtgggaggagcccagtcagtccccgggatgggagggaacattcatggccactgctttcctcccctggtctcagaggctgaacattggtgccctctcagtgaaataacacagcaatgctagtctctccattcactgtatgccagggagcccctaatcctatggcaacgaccccataaatcaggctcatggacccctaacccttcagagctcccggtcagcagagttctctcccatgccatggccctctattctggcttctgcaccctgccatgagaccgggagctcctggagggcagggcctgtagtttagctcaaaccttgcctctgtgactaccctagtgccttgcatagagtggatattcaatgaacatttatgagactttgaaaggcaggcaggtatgaaacatcatcttggtgcctgacttgagaatagaggaacatggatactagcatgtatccatgaagcctttcatcctctcaggaaaagcacaatccagcccatggcttggctacttcttgacgtgcgcacgggtgcagtagtctcatggatgagaatgccacctagtggcatggatgtggtagtctcgtggatgagaatgccaccagggtaggcatgggcagtgatgaaagcaggtcaaagaagaaattaaacacggttcaaacagatcttctttgaaataaagatatacaaaccatcacaataagtggaacagtgggggctggatgaggtgtctgtatgaaggcatggcagctacaaagtcaatatagcatcaatatacaaatttacgtgcgatgcaataggtttcctttgtttcaaactgaaggaagacattccatctcactgccaaaggcttacaaattaacgctgagggtcagggttcatggtacttactcaaggttcctgtggctgctgttgtagtcccataactttaaaatcattctatcatcttggagtactttctcttagtggggagatgatggaatttgttgatcataagaagtatataatgggagaaatctcctttgctaaaggttcatgtaatgaaagttatgaaaaaaaccttttttttcattaaagcaaactaatttgtcactgaagaaaaagtaattatttaaatgtttaaagaaacaacttttttcaataaagcaaattaattctttaaatatgtcggagtgtctccaggtactgactagtgttcttagaaaagaaaacttttaagaacagaaaaattcagatcaaaagaacacagcccttatctttcccccttcaaatataagtcaaatagtggctgtgaaactgactgcagggaaatccctccattttttataacatcaaaatggaataaggcttcattgctcaagctcatacataccaggtctgaaagcacatgtgggttaaatatctcagacttggtttgtttgaaatgatgttcttgctttcaatatgatcaactaaagacagttactctggacttagagcttcatggaacaacatagacttgattatgccaaaagtactttacacagcttgagaagtccactcttaacaggtgcctttggaagtcaaggcaaaggattttttaaaaaattgagctggaagagatcctgaccagtataactagacagcctgtgggattcaagaggtaacagcttatctgcttttaaacactagtacaataagagagttcacaataaagttggacaaccgccataacatcttttatcgaaactattgcaagtttctaactgatctttctgttttcacttgacccaatttggccaaacccacacagcctagcacaggctcataattctaccattatgtgcctgtgctccagccaaactcaatttctcactgttcaactgtatcaatatttgttttacctctctagcagtgaaaaaaattgagtcaccccaaaaggttgttaggatcattctcaagtactgtaaaaaccctgtccagaagagacatatcctcagacatgcagtcacacaagactctgcctttgaaaatacagatctatggaggatgagacaagagtttatatctctctgcacctgacctgggttgttttattgcttgttatgctactgactaatccagtgcttcccaaacatttttggagttttgacatttcactggttctaagcaaaacaattgtttgtattgtttttataaaatgtacctatcctacccccaagaatgctataacttttcaaaaaaaattaaagttaattaaaatgaatttggctttgagaaatttagaacaattttgtgaggtactttgaaatcctatgaaacactctagaattcccaaaacaaggagttgagaataactattttggcaaatatgtttgtctctccatgctttgttattcccacctataaaatgaaactaatgatgctcctactctttcccaagtttcccagtctgtatattatgagaacccaggcttatagaaagaactttgctttccccagaataaaggattcccatctaacccagataaagaaatttaactataactctaaaatctccttatgagattaacattctaaatgttaccagcaaaatatgagatactgaaacattacctgataacacagagacataaaattctttcaggctgcaaaaagatatttatgttactaaacttacatttgaagatcacagtgcttgagaaagtgtagatccaacatccaaacatagttgccattgggaaggaactgcctttagcttctgtgaacagaggagtctcttctgaggtagggatgggagttcaggactctgagaagataacatgtcataatttccactgggttctctgttgaaatgtttctttctgcagagagattagaagtgcagcactgggaggagaggctgaaaaacaaacataagcctcccttgttggagtacattttatccccacaaagttattttgtttgtgatcacaattcagtgaattctttttgatagaattcttttattgcaactgtctctaagaggctaaatttctccaagcagcactctggagaatcccagcattagacaataattataaataagggttctacaagtaaccagagacccaggctaaaaggaatgtgataggccatacagggtacggctctgcctccaggctgaataagaatcctaacccaaatggactgggaaagagtccatgtcattctaaaataataacaggaaagaatctgttatggattgaatgtgtccccgcaaaatttatatgttgaaatcctgacccctaaggtgatggtattaggaaatgggtcctttggaaggtgattagatcatgagggtgggaccatcctaaatgagataagtacccttataagaacaggccagagagctagctcactctctttcttctgtgtgagaacacacagcaagaagatggccatctgcaaccccaaagagggtcctcaccagaactcatattagcacccagatctaagacttccagcctccagaactatgaaaaataaatttctgttgttttcaagtcatccagtttatggtactttgctttggtaacccaaacctttctggatgaggcagaatccaagagttagagatttgagagtcagaaaacacctctagagatcacttgttgtagccttttgcagagaacaaaggtattatattaattttctgtaggcctaatgttaaggtatccttaggtgaaaataactaatgtgacatgagctacatatagtatacaatctcaaataacatgattacacaacttattaagatcctatgactatcttttgcatataaaaaagaagttagcgtaaattagttcttagctaatgtaaaagtactgaacagtcctttgtgctttttttttttttttttttttgagacacagtctcactctgttgcccaggctggagtgcagtggttcgatcttggctcactataacctccacctcccgagttcaagcgattctcctgcctcagcctcccgagtagctgggattacaggcacctgccaccacgcccggctaacttttatatttttagtagagatgggggtttcatcatgttggccaggctggtctcgaacccctgacctcaagtgatctgcctgccttggcctcccaaagtgctgggattacaggcatgaacctattgagcaactgcttaggttaacctactcctgctcttacccagaatcacgggtgactttgagctttcagaagaggaacctatcccttaaaagaccccaaagaaaccttggagtgatagaacaacatttcattttccctaggaatttctacgtgtttagaaaaggaggtctagattaaaccaagccacttctcagagctaactagacatactaacaggaggatgcaagtttcccagatcataagccaggcaaaaccacacacaattcctgcaagaatggccataatttaaaaattaaaaaataatagatgttggtgtggatgtggtgaaaagggaacacttttacagtgctggtgggaatgtaaactactataaccactacagaaaacagtatggagactccttaaagcactaaaagtagatctaccgtttgatccagcaatcactactgggtatctacccagaggtaaagaagtcattatatgaaaaagacacttgtacatgcatgttcatagcagcacaatttgcaattgcaaaaatatagaaccagcctaaatgcccatcaactaatgagtgaataaagaaaatgtgagatatatatctatatctatatatatatatatctcccacatacaccatggaatacgatttggccataaaaaggaatgaaataatggcatttgcaccaacctccatggagttggagaccattattctaagtgagtaactcaggaatgaaaagccaaacattatatgttctcacttataagtgggagctaagttatgaggacataaaggcataagaatgatataatggactcaggactcatgggtaagggtgggaggggtgtgagggataaaagactacacattgggtacagtgtatactgcttgtatgatgggtgcaccaaaatctcagaaatcaccacgaaagaacttttccatgtaaccaaataccacctgttccccaaaaaacaattgaaataataataaattaaaaaataaagaagatgacattgctggtgtgaatattaactgatggagccactctggaaaacagtttggccattaattctttcaaatgctaaatataaatttaccatgtgaaccagcaattcaacacctaggcaataaataaaatgaaaacctatgttcacacaaagacttgtaagtatgctcatgactgaattattcgcaatagccaaaaagtgaaaacaatccaaatgtttatcaactattaaacagataaacaaaatatgatacatccatacaatgaaatactagccagcaaaacaaaggaacaaaatactgatatatgctacaacattgacgagcctcaaaaacattatgctaagtgaaagaagccagatacaaaagactagatattgtgtgattctatttataggaaattccaaagacaggaaatctacaataacaaaaagtaaattagtggttgccagggttggggataggaaggtgactgactacaaactggcatgaaggatcttcagaggtgatggcaatgttttaagagtagattatgttagtggttacataactgtaaattcactaaaagttactgaattgtacacttaaaagggtgaatttatggtatgtaaattttatcaccataaggctgatttttaaaatgagggagaaataaggactttctcaggaaaacaaaaataatgatggaaatcctagccagtattcctacactacaagaaatctttaagaggtttttttataccgaaggaatatattagatggaaacataaatcttcacaaacaaatcaagagtgctaaaaagaaataaattatctgatctaaaatattactagaagtaaaatattgtgcagaagtagctatagtaatatcagacaaagtaaacttcagaacaaagaatgttgtcagaaattgagatattacacaataataaagaggtcaattctccaattagatataaaaagtataaatgtgcatgtacttaacagagcttaaaatatattagacaaactgtgacactactgaaaaaataaaatgacaaatacacaattataatgggaaactttaacacttctctcttagtaactgcaggaaaatgtaggcagaaaattagtgatgacataaattacttaaacagcactactattcaccttgacttaactgatacgtatttttaaaactacatccaatgcacgtttttcagcagcacatggaatgttcatagagatcaaccatgctgtgggccataaaaaaactcaacaaatttaaaagaactgaaatcattaaaagtatattctcaggagctgggcgtggtggctcacgtctgtaatcccagcactctgggaggccaaggcgggcagattgcttgaggtcaggagatcaagaccagcctggccaacacggagaaaccctgtctccactaaaaatacaaaaattagctgggcatgctagtgcatgcctgtgattccagctacttgggaggctgaggcatgagaatcgcttgaacctgggagacagaggttgcagtgagccaagattgcatcactgcactccagcctgggtgacagagtgagactgtgtctaaaaaaaaaaaaaaaaaaagaacgttatcaggcgatattggaaattaataaaagaaagatatttgtaaagagcactcttaagagaataaaaagactaaccacagactggaaaagaatatttgcaaatcataaatctgaagaagaacttgtatccagaataaaaaaaaaaccctcaaaattcaacagtaataatgatccacacagtatggtactgaaggaggtatagacacatagaacaacagaacagaatagcaaacatatactttgggaggccaaggtggaaggatcacttgaggccaggagtttgagactagcctgggcaacagagtgagactctgtctctacaaaaaataataataataaaaaaagctgcatatggtggcacacacctgtagtcccagctactcagaaggctgaggcaggagaattgcttaagcctaggagtaagccatgattgcatcactgcactccagcctgggcatggagtgagacactgactcttaaaaagagacgaaaaagagtatcagagacagaaatagatccatgcaaagatgcccaattgatttttgaaaaaggtgcaaaaccaattcaaaggaagaggcagagttttttcaacaagtggtgttgaagcaactggacatacatggcggagggggggaaagaaagaaaaagaaaaatgagccttgacttaaatctcaaactttaactcaaaatggaacatagtgtgaaatgtaaaaatgtaaaacttttcaaaaaaacacaagagaaaatcttcagacataagattaggtgaggagttcttacatttggcatcaaaagcatgacccataaaagtaaaaattgaaaattatacctcatcaaatttaaaaactttgctctgtgaaaaactctttcaaggagatgaaaaaagacaaattacaaactgagagaaaaatttgcaaattatatatcccacaaaggacttatatctggaatatataaagaactctcaaaactcaacattaaaaaaaaaatccaattagaaaagaggcaaaagacatttaactgaaaaggatacacagatgccaaataagcacatgaaaagatgttcaatatcattagccctcaggaaaatgcaaattaaaaccacaatgagatattgctagaaacctatcaaagtggctaaaataaaacactgtgacaacaccaaatgctaatgaagatgtggagcaaatggatcactgacatcgctggtcaaaatgtaaaactgcacaatcactctggaaaatagtttggcagtttctttttttaaaaaaaaaattagtattattatttattatactttaaattctggggtacatgtgcagaatgtgcaggttagttacataggtatacatgtgccatggtggtttgcagtttctttaaacactaaaaatggattggccaggcacagtggctcacgcctgtaatcccagcactttaggaggccaaggcaggcagattatgaggtcaggaattcaagaccatcctggcgaacatggtgaaaccctgtcactactaaaaatacaaaaattagctgggcatggtggcgcatgcctgtaatcccagctactcaggaggctgaggcaggagaatcgcttgaaccagggagttggaggttgcagtgagccgagaatgcaccacagcactccagcctggcaacagaacaagactccatctcagaaaaacaaaaaaatatatttaccaaatgacccagcaatggcactcttgggcattcaccccagagaaatgaaaacttatgttaatgtagaaacttgtatatgaatattcacagaaactttatttggaatagctcaaagtggaaactaccaaaattgacaatgcttaaattatagtacatccatactatgaaatactatccagcaataaaaaggaatgaactattgatacatgtcacaacttgaaggaacctccaggaattatgctgagtgggaaaaaaagcaaatatgaaaaggaaacatactatatagtatgcttccatgtatataacatccttggaataacaacattatacagatggtaaaccaaatagtggttgataagggtaagggatgtagagtaggaagtgggtgaggctgtggagaggtaatatgagaggaatgttgtggtgatggcacagttctgtatgttgattgtcgtggaagctacacaaaactatacatgtgataaaattgcatagaaacacacacacacaagtatatgtataactggtaaaatctgaataacctctgtggattgtaccaatgtcaattttctgatactaatattgtaccatagttaggcaagatgttaacattggggaagggtgagtgaagggaatacaattctttgcaacttcctttaaatctataattatttccaaataaagcttttaaaattaaccataagaaaacaagcaacccaatattttgaatggacgagaatataaacagaaaatttaccacagaagttagatggatggcaaataagcatgttaaaagatgttcaacattaataatcattagagaaatgcaaattataaccagaaagagataccactatacaccttagagtggcaaaacaaaacaaaaacacacacagaaaaactagcagtaccaggtgctggcaagaatgtggaacaactggaactctcaagccctcctagtgggaatgcaaaatggtatagccactcagcaaaagtttgacaagttctcaaaaagaactataacccagcaatttaccaagtaacccagcaatcccactcctatttactcaaaagaaataaaaactatgttcacacaaaccctgtacacaaatgtttataacaatgtatccataatagagaaaaaatggaaacaaaccaagtatccctcaactataggactcataaacaaaatgtgatacatctatacaatggaatatgacccagcaataaaaagcaatgaacttctggactgggtgcagtggctcacgcctgtcatcccagcactttgggaggcagaggcaggtgcatcacttgaggccaggagttcgagaccagcctggtcaacatggcgaaaccttgtctctactaaaaatataaaaattagccaggcgcaatggtgcacgcctgtagttccagctacttgggaggttgaggcatgagaatcccttgaatgtgggaggcaggggttgcagtgggctgagatcacaccactgcactccagcctgggcaagagagtcagactatcacacacacacacaaaggaatgaactactgaaaacacaacaacatagttaaatctcaaaagcattttgctacctgaaagaagctacatccaaaaggttacaaccatatcattctgtttctttgataatctggaaaactatgggaatggaaattagatcagtggctgccagggttgagaatggagaaggggatgaatgccaagaggcggtacaaagcaatttctgaggtgatggaattgtttggtaactttagtgatggcattaggcaaaagccataaaacggtacaccacaccagtttgcactgtgtaaaaaaataagtaaacatgccaaaaaaggatccccctgcatacccacctaagtgacaacatgtgctgtcaaggacggagagcaaatggaactcacacattgctggtggtaatgtaaattgctacagccgctttaaaaatctgtttttcaatatctgctaaaattaaacatatgcatatcccataaatcatcaattttacctctagacatgtacataacagtaatacatattcaccaaagaaagtaaatccaagcatgttcatagcagctttgcttgtattacaaaaacctgggaacaattccagtatgtacaaatagcagaatgggtaaatatatcatggtatactgataaaaatggaatagtatatggcaatgagaataaagtattgctgacatgacaacatggatgaatctcacaagcaatatttaatataaaaatccagacagtaataagattacgcagtgtacgatctcatttatataaagtaataaaaaatgttgcaaaatagcgattacctttgggcagaagtagtgacttggagggtattacaaagaggtcctagcggtgttctattttgtgatttaagtgctggctatcttgttaagttgtgaatgttcatcagtgcattcacttaatatttgggcatgttttctgtttgcaaattatacttccattaaaaatgttttaggccaggcatggtagctcatgcctgtaatctcagcactttgggaggctaaggcaggaggattgcttgaggacaggaatttcagaccagcctgggcaacatagtgagatctcatctttaaaaaaaatttttttttaatttgctgggtgtgctggtgcatgcctgtggtcctagctactaaggaggcggaggtgggaggatcacttgagcccggaagtcaaggctgcagaaagctatgatcacatcactgcactccagcctgagtgacaaagtgaaaccctgtttcaaaaaaaaagtttaagaacttttaaatgtatgcttcattttctcttctttttaaaatttaggcttgcttatatagccaattgctaaaaatctgtaactaaaaccaagactacagtagctcaatgcatagaagttaaagatagataaggcaattttgtaacctcgccttttactttctgtttgttggcttttacattacttcaaaattgttaaggagtaataaatgcctgtccacgtccattcctgtctggcctagaacatttaaactgtctataagtcttttggctgtaagtctcttggccatagagatcctaccaagggacaggatggacctggggcaggcagccaaaccacctccacaatgctatgggacaaaataaaagtttgtccattgatgttgcctctggcaaatcctggccagaaggaaagaatgtaaaccaaaaataaaattctaagctccccaaccacctgaatggacccctcctcttggccaagggcattccaaagttaacctgaaaaactagttcaggacatgatgaggaagggggagtcggacatgcctcattaccatcaacatgaacactgtccttaagactgatacaatagactctttaagtctaataagaaacatttacaatctattctctctgaagcctgctacctggaggtttcatctgcatgataaaactgtggtctccacaactccttatcgtaaaccagacattcccttctaatgattccaggtctttagataataactcaaccaattattaataccagtcagaaaatttctgaacctgcctatgacctggaagtcctccaacttccatttgtcctgcttttccagaccaaacgaatgtacatctcacatgtatcagttgatgtcttatatctccctaaaaaccaaactgtggcctgaccaccttgggcatgtcaccaggaccttcttaggcagtgtcacaggcatgtccttagccttggcaaaataaacttctaaattgattgaaaaaaatttttaggttttctgataagattgtctgattccaagggagaggtgtgagaattatacatgaaagcttttgttcccaattggacagaaggatgcaagcgacttttgatcacctgctctaccatgaatagtgccacgggcttcacaacaaccacgagaggtatgtattttatgtccactttagagatgaagaagactcaagaacaagaagattactagtttcagttacaaatatatgattccagcatttctagaatgaaaaactcaggaaatatctgagagagaaaggtctataaagagcactaaatccagcccctttattttacaaactgggaaaatctgtcccaggagggaaagggactagttcaagactacccaactactcaaagagaaggaactcaaatttcaatctcttgagtgccacccagtggacaatgtaccatgaccgatatttacagacaagttaccaaaaaactttacagaatagggggaaagagcactcattaaactgggaattggaagaactggatcctgtcccagttttgccaagtaaggttagcttcccctctcttggctttaatttccccatctgtgtaatatgaagtgacaacaggaaaaccaacatgaggcagcaagtcttggatccaagacagagacagatccaggttttgtggggcttgaagcttgtaacatctggggccttctttaagtataagaatgcaaaattaccagtataaaattgggaacaaaagcaaatatttaaagtgagaaaaaaaaaacaaaagaacacacatttgaaaacgttgacaaatgttagaaacatctgaaaatttagaaaaaaataacataaatagctacttatctttagtacttaactgcctcatgcacttctatagtatgttattcctgcttttcttgtttgttatagttggaaacacaggattcagcatatagttataatcacaaccaagatttattacagcaatgtagttagggcacacagccagatcacaagcagaaaagacaggcaaagtttggaggagcccatgcacagacttccttatgctctctccctcccatgaggggccacacagagcacatgcttctctcggcaacaaatatgcagtggcacgtgtgatgtttctggccagagaagcccagactcattgcccacactttacactggtgtttggtaacagagacttcctctgcctagcatgcaccaaaattccagactcccagaaggaaagcagatattcagcataaactacgttttctgtatcaacagtcaaggcacagtgagccatcttatcagttaactgttgactagggaaattctgagagtcaagtttccagatgccagcagggagcgtaacttccaagcaggtctttctaagggtagcagtcacaggaactatgactgtgccctttctagctcaggacacatttgatgctgtgactgtttgggaattcagtcccgaccaatttaagaggttgtgtttcttagctgtctctggctcctggtttgcgcagtttaattctgtgcctgcccagcaaaactcttctgcatactactcaatgtttctagtccttctacaggtccatgtcctacaatcacaggaattctgaaaaatgccatttcacaaaatccccttccaaatgtgcaaataaatgtatcttgtatttacaattgcgtacactgcacgctgggtatatttctgacaagagagcacttttgcttttcagtgaaaatggaatccttcacttacaattttacacatctgattgatgactggaagatttttccacagactagcttctggtgctgtacattgtgaatcttggttctcctccactgccaacatacccctgatgccaagtgctgcaagtcacagtgacattacaatgtacccttcagcctcacccctcttgtcctaacactggatgcatcagcacagtgagcagaagtattcctgcaagctattccaataaagggcagctggcaaaaactgggaaatatatggaattgcctgtggactcctgaaagatatctcaaaaatatatcctaaactaaatgaatcccaacttaatgtccccttagttgaattctcaatatgaccatggtcattgcattgctacccaacacacaggcaagagggatagagacagcatagtggaaagaaagattccctgaaccaactgtggttaaaatatcttttgtagattttccaaaccatacaactgtaggaccataatgctagggctccttccagggctgttcaagcaagagacactgaagctttatctttaacttcattcacttcactgtgtacttgcatcgggtctagagacttacagaagagaaaccatgagaaaagacatagggcccagataatgagacagaagggaagagagtacacaatcagaaacaaggacaaggaaattaagacaaattccagataaacaaagtgcaaaatttacctgggaatgtgtgacctgcatgtgacctagcatgggagaggcagcctgaagagttattcttcctaagctggggcacaacacaaggacaaaaacaacagagctggctttattccatggctgagccaggaggacataccatgagattctgtcgatattgagtggacaggaagaggactagttcagagatgtcaggcttcttagaccacagacagagaggttttgctaggcaggcacagaatcaaactgggcaaaccaggagccagagacagctaagaaacacaacctcttaaattggtcaggactgaattcccaaacagtcacagcatcaaatgtgtcctgagctagaaagggccttctagttaccatattccaccattccaccaccatcttgtggtgtagagatcaaatcaccatagtcagggtcaaaaagactggttgagtcctgccttgatcacttacagtacaagctgaggcaaatcacttcccctctctgaatttcagtgtcctcatctctcgagtgaagagaatgataatgtggtcccaggagcctgtgaagaattcagtgtcacattaggatgagaaaaaggacctggcgaggcattcctgctgacccagaacacaacacaagaatctaagggcaagcacgctgtaagcttcaaagccttgcaggaatgttacctttcctttactacagaggaggcaccagcaggggaactctcttggcacacagttggagtcctcagaaaatgttgattctcatggactcttctctgtctctaatgtacaagcagtttcaagcaggggtcttgttggtattttagggggaaattgatggtattactttgggattaatttgataagactaacggtcattttacaaagagaaagtcatcccataagtagtatggctgggaagggagaaggaaggagggcgcaggggacctgagcaagcattgaaatatctaaacgagaggtaagaaagcaagggcagttatgctgtgattgaagatgacacttgcacccctatcatctccccaccaacctctggcccagatgacttactggccacaagtgaatcaatgaattcttctcaggaagaaaaccagtttgcctttttaaaatgctgacagtgaaacccaagtgaggaaactcacctgctgcacccagcgtgcagcccacactccttcagtggtcctttaggagttggaaccaatctagtttcccagcctcttctctcccatgacttcactctacgaatgcgtctgctccagccacgaaccttctctgggctccttgaatgtacctaaccctttcagactgtccttcccccatttcccacctaacaaaacccttttgaccttcaaggcccagctcaaacaccccctcctctacgaagcgtcccccagccccctgcccagagtagttccttcctcttcacattcacctaactcctcttgcctgtaagatgcccccttacaagtaacaaagacatgagtgtgcacctaccttcaaggagcctctttcaggagggggcctggcttccatctgctttctgacatactttgcatggagatctgccctctcctgccaggctgtgctcacaccaataccaagagatcacgagacgccctgccagcaaatgccctggaagcacatccccttcatgcccctggcagtcatctaatgtacacacaagatcaaagcagctctcaggtggcctgttgcagggcacagcacagttctgcctatgccaaggcagatgctgggcccttccctattgtgttcagcacacacccattctccagggcaccttttctgggcattaatttatccagtcagttaatatggattgcacagcctgctatatgccaggtaccatgtggaccccatcacccgtacccaatgcaggcccctctagtgggcaacccttgctccacacctccctgttgggctgctcgagactgtcaggtcgggctcaacctgctctccagccctgtttccttcctatccctttcctgagtgttagttagccccagtaaatctttggccctgccaactccctctcatggtctgcttcctggaggacacaatctgagacagtgggttccagagtggtctgagaaagcaggtggtaaaatggggtcttggtacaggattgccccgcatctgcccaactggcaacaaggttcccatcttcgggagtaggtggcacgcaggcggctccaggcacaagatggcaggctagttgccagacctttggtgttagaacttttgctgggatggccggcttgtggagaggaagttcctggcaggtgaggagatccaggcagggcggatgcctggaaatgaaaactcagagaacagacagtggtgagtatgtttcctggatgacccacaggggattaatgagagaccaagagcaattaacaaacatctaaaaattaaccagaaacactggagtcttcctggtggtttacaaagtagcccccgatccaggcaatgggcgagcagcaaagtctgaagaacaaacccaggacttgctaaggtggctgaactccaaagacaggtgaacgctcagccaaggcaggtctgtcatgccaatgacaccagccctgttgggaaaacctgcgtccctgatacatggaacaggcacatctagaaggtctctgaatatctggtctccccagatgcccttgaaacttctgagcccgcagcatcagcccaccccctcccatgaagcgctgcaggcaccctatcccgaaggagaaataaataacacaagaattttccccacaggtgtcctccctcccaggagtggccctcaccttatcactggctgccaggtagggtgaccaacagtcccagtttgctgagtgaattgcagtgctaaaagccggcaagtcccagggaagcaggaggaattggtgagctgactgccagacccgtgaccagagtgaaggtgcagcgcagcgccatgcaggcagggtgtgctgggtctgggaagggggaaagcgatgacaccctcgaggagctgcaggatcagcatgcatctgcagcggccagggggtccctgtgggatgggacccggatgcagctcaaccagtggggacttggagacactctgctgctcaacacaactgaatgccctggtagggagccgaagggatggggcaaacctgttgatggcatgggatgggcaacagtgatggtccaggcctgagtgacggtgaaaggcctgaactgtcatggcagacagtgaaggaagggattcaaaggctaagcaaagtgagcttgctggaactggacagaagaggtgaggccagaagacaccccggagaatcaggtttcaggagagggcccagaggacacgtgtcagcaagggcatcaggaatgtgctgcagagagggcgccagcatccttcagagatccagcgcgggaatcctctgcagaccagggctgaccacaggagagtgtcttgcagaacggggcgcaccgagaactggaacctgataagggtggtgcagcctcgtcctcctcctcgtttccttctcctcctctcctcctcctctccaccttctgtcctcctttcttcctcctcatttcctcctcttactctcctcctcctcccacctcctgctctccttctcctctcctcctcctcatcctctcctcttctctcttcttcttcctacttttctccttctcatttccttctctcttcctctcctccttctcctcttttctctttcacctcctccaactctgttcctcctcctctcctctccactcctccccaaccccctcctccttttcctctgctcctcttattccactcttcctcttcctcctttcctcctcgtcctctcctcctggtcctcctttcttcagcctcctcctctctgctttctcctcttctccgccttctcctttcttcttccacctcccctcttcctccaaatctcctccccttcctctcctcctcctcctctgctcctcctctcgtcctctcctcctttcctccctcctcctatttctctccttctcccttcctccccgtcctccccccctcctctccttctcctcttttctttcactcctcctccttttctcctcctcttctcctcctgttcttttctcttcctcctcccccctcatccctctcctctccttttctcctcctctttctcatcccctcctgtcctccacctcctctcctccacatctgcctctccttccccttctgtccttctcctctcctcctactcccccctcctcctccttacttgctcttctagtcctcttcctcttcttcctcctttgttactcctcctcctcttctccgtctcctctcctctttcttctcttttctgtgtcctcctctcctccttcacctcttctccttggtctcatctcctcctcctctccttctcctcctccttccctccttgaacccgctccctctcttccccctccttctcctcttttcttctctcctcctcccctccagctcctattcctccactttacctctctcctcctcctacatcgcacatccgcacgaccctgtgagagtcagggcagaaaaggaaagctaaaaggcggacaaatgagtgcaagagagcaaaaaagggaaccctccctaatctaatgggcagggcactggacgcatgcgagcacctcctccttgggggagaggtcacagccttcagatggaggggcagtgggacactccatgatctctggggttacttacaatttggagtgcttaggtgaatactgagtccaaaacagccctgcaaagacacagaagaacaagcccctgtgcggacgaggtctctgaaatacaaaaagccaacatggggttagaggcagaattcagaaagagctcctacaactccataccaacaaggcaaatgactcaatagaaaaatgggcaagccaggcacggtggcttacgcctgtaaccccagcactttgggaggccgaggcgggtggatcacctgaggtcgaagttcgagaccagtccaaccaacaaggagaaaccccatctctactaaaaatacaaacttagccaggcatggtggcgcatacctgtaatcccagcactcaggaggctgaggaaggagaatcgcttgagcccagaaggcagaggtagtggtgagccgagattgcaccagcctgggcaacaagagcaaaactccgtctaaaaaaaaatgaaaaagaaagaaagaaaaagaaaaatgggcaaaagccatttcctagacgaggaaagcaggctgaccaaaaagcatctgaagggaaaccatgaatcagggtcaaagcggtcccagactggccgtgccccggaacactaggcaggatcaaacgtgaaccatctccagagaagggcaacttcctcctgggcctcagagtcaaaaaagcacagcgaggagaggtggctgcactctggaaagtgtcagtggggaggcaaaggaagaggaaggcggtgacaggctcagaaaacaggaggagttgcacggaaattagtctgagcaaaaagaatgcttctctaggggagcatgtgggcagaagagaaggactgcacagccggggatgctgagcacagagaggcaaggtgatggcaaattcgcaagggacagctctagccagggaggttagcctgccatggagggagaggacagagcaggagagggcagggttgggggcagggggtgggggggcagggtagggtagggaagggaagcggggagagggaaggggaggggaggggaagggatgggaggggaaggaaggggaggtgaggctcagaaggccaccaggatggaccgggagctctgcagggggctccctggtgatgaggaaggaaggaagacctgagcgggggctgtggtttcaggaaggaggcagtatcctgggggaggcaggcagagggtacagtcagctgcaaagcaggatctttggaaaaggcaaggacttcctaaaagagatatgatgtgtggcacgataggcatgcaagcaaggcctgaagaagcaagcagaacttgaggagacacaccgctggccccaggagtgggggtcagttcagtgtgtgctactggggtgcagtcaggcacagtggtttcaagggagcacagcaaggaacccaagaaggccccgcatgtctgcagttggctgactattgcccgggactccagagcatccatggagggccccacaggggaaggcaggagcaggacgggtctagggaggtgaaggccgacctgacctgctaagagacgagaagagagggaggggaaagtcttgttcctgccaggacattgttaatgagaggagtgagaaggcagcaggtgaagagagtgtggcatggaaggcagaaatcagagcgtttttgggtttcgtgctgacctgctattgggaatgaaaatcaagactcaggtgcattctggtccctttctcagggttagccgaacaccacccgcatccctgcctggcctgttgatgccattcttcctaggcccactcaccgctgcagctgctttacttgcacttcctctcgtcatccgaccacagatcagacctctgctgctcgctgccgcccagggagagtgtgcacctacgtgcacattgcaccccactgcccagcacacccaggagtgagagtgaggagcagctgagagagttggaaaagggagcccttatgtggccaccaagggcttccctgctagcagccacacggtggctatccagctcattatgcgagttctagttcttcaaacaagaggccacgggaggagcaacggccacccaccatcccggggatcctcattcatgatctgaaaccactctaagcagattctggggtgttcggcagaagctggcaaccattcttgtggggaaggaacccaggaggggatgctagcatacataggacttggaactggtgatctgaaggtcccctgcagccctacggcctacatcccataaagagggaccctctcctcctcacctcatctccagcatttctgcttcctcaagcttctccagggagaagtaggcgcatctcactagaaaaaacaagaaagctgccctttgctcattcaacacttactaagcagatactgtgccctgggcacccagtttcagaaatgagtaaaacaccggccttgccttcaaggaactcaagagaccctgcggcagccacagtcttacagagcaattaccaccctgggttgcaagagcctaacgtagggtggggacaggggaggtacaaaatgctatcagagctggagacgaaagtctctaatactcggagtggggctgtgaaggtgactttaaagttgtgccttgaaggaggccaggagcgcaccaggacaaggccatgggaaccgccggtgcaaagcagggagacctggaacagcaggctggtggggaccagtgactgaacagcacagcgtgaacccaaagagtgtttggcttaagggtggggagagctgagccgactccctgaactgctaggacttaaacctgagaaggcccagcagcgttttcactagaggattgctggggacagatttgtgacttagaaactgagccgatggaatgtggacgacagacctgagggaagaaagacagaggactccaggttgctcaggaggctcatggaacagtgcaggctccagaccacgaggcctgaattctggaagtagcagcggggatgcaggacgaggagccgttttgtctcatcaggcactccagaggcagggacccagaacttggttatgaagtcaatgcgggagactagataaggggagggacagaggagtaaagcatggcagcactacagaacctgagcccgtgactgagagaagagagtttgaaaagcaagtttgccagggaagttgggctgtgtgctgggcgacttaggccggaggaggcaagacattaagaggggggatgtttctcattacctgcaaaagaggcgttaaaaaaacggtccctctggaccccactggcaggcactgacggagcggccaggacacaggagagcaggcctggggggctcagccctgcaagactcagcctagagctgcatggaccccagtcaagtgttcccgcccttcttgctgcttctgtgccctctgggggaagacactggaggtgcagttaggtcgccgcgggaaagtttggactcttgcctaagggtgcatcacagaagggcctcagctccctcccccaactccacccacagctccacccctagcttttcctcctgcaagtccgtccccaacttctcctcttgcagctccgcccacagctccaccccagctgttctgcccccctgctcctcctccctcagctccgccccagctgttcctcccacagttccgccccccagctcctcctcccgcagctccgccccagctattccgacgccagcccctgctccacccggcacttaaccatttccgcccacagctctttcccacaactacgccctcctcttgcaggcggctcctccagaagctctgacccagtccccgctgcagccacagccccagcttcttacccccagctcctcctcccacagctctttcccactgccccgccctgctaccccttcatcaccgctcccagctccgcctcctctagccccgtctcgcttctcctacccctctgcccaccccaacaacctttcagctctttcctccagctctgcactagctcctcccccgcaattctcacccgccagccttggtgcagcttggctcctccttctccagctctttcccgcagccccgccccatctgctcccacagcgctttgccacagcctcgccctgctcctcctccaggaacgcccggctttccctcagctccaccctgcagctgagctgtgcaccaggccctcccacagagctttctcgtgattccaccctacacctccccaagccgccgctcccctaagctggttctcaggagtccgcggagtcctcccgcagctgttcctcgctcaattgcccactgccccggcctgctcctcacaccactgatggcaaagccccgaccccagaccctccccagtggtttctctcggcccggccctaccccgcccctccaacgcctgcttccaaggccccgcccccagcccatcctcagcggtttctctcagctccgccccgccccagccccacccggctcctcctgcggctggttaaaaggccccgcccccagccgctccccaatggcttcgctcagacccgccctgccccgaacccccccctgcttctcccgcggctgcctccgaagccccgccccgcgccgagccccgcctctccccatctcctccctgtttctcccgcgggtgcttccaaagccccgcccccagcacccccctcagcggtctctctcagcccgatccaacccttttctgagccccgccctgtttctcctgtggctgcgtgcaaaccccaccccccagccccaccccagaggttcccctcggccctgccccgcccccccagccccgcttctccaaaggctgttttcaaagccccgcccccgagcccctccccggcggttccctcagccccgccccacccctccccgagccccagccccccccgaaccccgccccgccccactcctcccccagccctgccctgcttctccagcaccagcttccaaagccccgcccccaacccctccccactggtttctttcagccccaccttcctcctctcaccagccccctccctccccgcgctggttctcaggagtccgcgagctcctcctgcagcctctcctcgcccagatcgcccatagccccgcccccaatggtttctctcagccccgccccaccccctcgagtccccgccccatcccaagtccccgccccatcccctcaagtccccgccccactctcaaccccgccccagcggtttcctcactcccgcccttcccctcccccagctccgccctcctcctctcagccccgcccccatcccctccccattggtttctcccagttccttcctgctggtctcgcagctctgggcttaaaaatcctgcctggtggtctcgtcccgcccctcctcttcctccctccggttccttttcctccttccggttcttggtctaggctgcctgtctcgagctccccggccttgtcctggttggctggcgcgggacaggatccggtaaactgaacagcgtctccttgtggcaagtgcgtgcgtacgtgcgtggcgacgtcactgcgtggcttcgtgaatacgtggcttcctagcgatttggcggtgtataggcgtggctgaatacgggcctcctgcgtacgtgcgtggtgtacgtacgtgcgtgattacgcgcacacgtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaccagggcccctgatgccggagcccgtgtgctcggccctcttgcagacggtacttgcgggctggggtttctttcccctgggtttcgggcagagaacccgtgcggggcgcgcccgaagcgccctttggtgtcccttgctctccccatggtctcggcccccctccttctaagcgcgtgtacccgcgacctgcgtctgcaagtgctgctccacacacagcggccccatctcggcccggtcttccctgcctcccgcttggcccctgtgctgtaagctcgcctggaccccaggccgggcggtgcatagctctgtggcctgtggccccgtgctcagcatgacctaaccagaattaagcagtggacaatgggatttaggccccccaaaccctcgtccgatgacaatgggaggggaagtgtgatttttctcccctcggatggagcgtgctcagctgtaggaatgtgactcaacttgctgaaatgattttctgctctgcggactggtgcaccctgtgacccagacagatgtggagggtcccaccgctctgattagcagaaccaaaccgtgagtgaggtgcacatgtgttactcttaggaccggccctcccagctcttggtttccaatgcctgctgagtagaagaccttcctagggccattaaccagctttgctgacttgcatttaatgacctttcctctttatcttccttgttgtgcaggtaaagaaaccaagtggaagagtgtttcctcctctggccgtaaagcaggtactctctgcagcaccaggtaggaggggactcaacccccttcttgccttttcagttacatcagttcctactagggattccacacacacacagttgttgtgattttgtggtgatgacgagaaaagggttggctaagaaactgggcggcagaaaagaggcaaacattcactgtagccatttatcccgatggaagtggccaggccctgtgggggacattcagcctccgtcagaagtaatccagaaccaaggaacctggttatctttggtcactcatcagaagaataatcatgctcaggggccacaagtgtgtgaggaaatggcaccatggatgggttggtggagggtacacgggtgagtctttgtggaaagtcatttgctggcagatatcagcatcttagatgggcgtgccaggcggccgaggcatttccttcagcatgtcttcacacagcgagtgttagaagtaatgtcatttctagtggcaaaagtgggaagcaacttgtaactctccatcagtggaggaatggtcaggcaaattatgagacgaccaacaatgggatatcacccaggcagtgaaaaacaaggtagatgaagattgtcaggtggaaagaatgggcttgatgtgctgtcaaatggcaaactcgtgccctagcctgtgcagatgtgttgggaacagcagtttgccaagatggctgaaacaaaggaccataaaggggctggcttaaagaacagacaatcattgtctcgcagttctggaggatggaagtctgaaatcaaagtggtggccaggttcgtttgttctgtgggctgtgaaagacaatctggtctgtccctttctcttagctgcaggcggctggccggcaatctttggcactcattagcttgtagaagcatctcccttatctctgcgtttatcttctcatggtgttctccctgtgtgcgtgactgtctctcaaatcccccttttcataaggacgccagccacattggatgcgggtccgccctgatggcttcagtctcacttgattgcctctgtaatgactctgtttttatatataaggccacattttgaggtgctggggtttaggacttcaacatacgcattttaagaggacacaatgcaacccatcacaactgacaaaggctctgaggtagaaacaagcttggcatgttccctcaggggatggaaggcctgtgtggcttcagggtggtgaataaaggggagaggagaggacgtggctggggtgggaaaccagatcaggagggaccttgagtgccctgagaggaagtgtggattctgtgctagttggggcagggagcccttgaaaggtttcagtagaggagtgacataatctcattgtccctgtaccaagatcattccgatggcagtgtggtcacaagagtgcagaggacaagtgctgggggggggtgggggtgctatcaggagacttcttcagaaggcagggggttttaggggattggattgggattgtggccatagagattatggaaagggatcagattcagtgtcggttttggacacagtgccacgggatgtgggccgcagatgtgggaaagaaaggcagtgcagagagcagctaggtctggggcaggaacactgtagctggtgatgccactcacagaggtggaagggaggtggacttggtggtgatggttggggtcctgagtatgtatgggcctgtccacctaaggctgagtctgaaggggggtggcctgcaccacgggattcagagcaggacggtgagcaacatgggggtcccagaagaagggaaggagtgtgcccagccatgctggggctgctgagcatggactaagatgaagacaggactggcatgaggccggccatgggtgcttgtggggataggtcagtcagtggagtgggtggtggggggggtggggaataaagggagaaaggtgggggtgggggcagaaggttcagagaggaagtagagactgcgcatgtagacagctcttctgaggtctcggctgttcagggttgtagagaagggaggcagagtgggaggcgcgcgtgtgctcagagtagggatgctgagcgagcatagatggtggctggtggcacccagggcccggagtgagccagaggagcagggtccagagcacagcaggcaaccggctcagctgaggcagctcaccccagaggcgggagaaaagcaggagatctggagctcagaaggctgcagtgcagactgggaaaggagtgaataccaggcagctttggccctatcagggctttgtctcatgagggtgggtatattttcttaaaatcatagagcgtactagaggttgcgtttatgtgttgaaaggaaggacagagagaggagtaggggcagctcaagggtggagttcagggccagggggcggggccacgggcctgaggggtgagggcggccactatttctgactgttctgttaggtgccacgtactgggctgggtgctcttggtgccttatctcccttcctcacagccatgtggaaactgaggcatctcaagagtctatgactgggctgaggttctggtttcaagcccagggttccttccaaggcacagggctgtcctccgtgcaagaggaggggaccctctcccaagccacacacgcaggaggctgggcaagagttgtgggaagtcagagcccgtgtgactgtgggctggtgcctcattctcctcagccatagagtgggcctcacagtaccactgaccctgctgggttacttgaagattcaatttgatgatctgaagatcatgccatcccagaggctggcacgtggaaggcatgtgtggggggttgccagttgttctgattatcattcttcttttctcagctcagattgggacaggggcgtctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaaggtcagtgccttggtggcggcagggccagggcactgagagtattggcagggcacagcaggggaaagggaagagaagcagagcgtgggactgtccctctgtgctggaagagggctaacaccagccccgactctccgctctggctaggccgagggggccctctgtcctctgtgttgccctagggctcggtgacctctgtcatagcactgaccacatgctatcctgcctgtgccttcctctagctgtccccgccctactccggaccgccccaaagactccatgggatggacctgagtcagccgaatcctagccccttcccttgggcctgctgtggtgctcgacatcagtgacagacggaagcagcagaccatcaaggtcagtgcgatttaggccacctgagagacacggggggaaggtcaggccactgcccatgagcttgaagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggtaagtgacaatgtaccaaatgcgcagacaacgcctagggctgctgcccaagatcttgcttgggaatttgggggcttctcttgtcatctgaactgattggcgtgtataacacagtttcctttggcaacacaccttcaaaggggcggcaaggaccttgggctgggggttggtatggctggcttccgcaagctctggtaaatcatttctccactctgggccgcagttctgtttctgatctcagtgagaagcctggtcagggccatgtgcacatggtgtttgtggtgtttggctgtgtgtatttgcacatacatgtgtgagtgcacatgtgtggcagagaccatgaaaagcagcccagcccgccgaatgggtcaggtggcctctagagttgggctgcccgcctggcttcatgaacctgccccagccccaccactcacagcaccctgggaaagtcccctaacctctaggtgactgaggcccgacatcagcatctgtcccctggtgacctgctcaggcatcacctgtagcttcccaggcagtggctggtgcccttccaatctgcaaccgctgctctcagaagtctggcttggacctgcctcttacttgtgtggcttcatgaggacaaggccctctcctctgcctttctggagccctccccctgcctctcccagcgtttcctgaatcgggtttggttcgttatcaaagctacggaagaaggacttgactcccttcttgtcattttgctgatgctgtcttactctctattgattgtgactttgagtaactgtgttgtcacatgggcaggccttgggctatggaagtgaaaggcattcatgtgtatctctctttgtgtacaggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacattacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatagaaggttaaaaaaaaacacagacaacagttctcatttaaattgtttattatttatttccatggaattttgtttttctttattaagaccaaaaatgtgtttctcattagaaaatggcaacttttatgggccattagtggcctgtgagttcacgaatttgcagtgtgtctgaactgttcacagagtctacacttgtaatctgaggagccttcctactcctcctcatcgtcagagggctcatttggagacatgactgagagggaggccaacagagcgtagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgagggcatcctttctctggatattctccaggagcctgggcttgtctctctgaaaattggagttgcagtagatctgaaacaaaatgaaacatgttagttgttctgggataaattattcctttcccacctctcaaaattatgattttgttttgcaatggagaaaagaatgctttaagtggcagcaagtgtggttatgctctacagcatgacctgactaaagataaacaattcatagatcaaggcagtaatatataaatagcatggattttgatattaaactgcaaccccgtagaggtaatatgcaggtctgcaaaatatgatgcttacattatctctaagggggttgcagtttaatatcaaaatccatactttttaagttctatacttttcatctttcaataaacaatatttcacattttcaaatgctatctttgacacttaagctcttacagtatattattcaaattggtgtcctatgaagatatgtttgagaaagagagaaaagggattacagaaatgctttctactttaccatcattttcttgtttcctggagagttgcttgggcgtgttttgcagaatccatagaggttcagctggcgaatgaaactcgtcaagttgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaattctagagtctcggtatcagggcaaccagtggcttaactcatcatctgctgtatttgtcgcatgatgtcacaaaggtggctctcagccaatctggagagggggccctggccaggtgttgggggagtagacaggtggcatggccttcagcttctccctcttctaaaagtataaacaggcatggttcaagttcccagaaaagtctcccatcttctgacagtcacattgtgtcaaagggccaggccccagatgagctgagaaaccatggctctatggccactcccaaccctgaagacaggggaggccatttgctggcctctaatttgctcaagagccagcccctagttatccctagcttgggtttcaccaagactgcctgactcagatggacccctcatgggtgactgccttctaggagatggtggtccctaccaggctgtttggcctgatctgtgtggtagcacccctcttttccaatccccccatctccttcctgctttggtctcttccaggtactcctaatgattggttgcatgtgctccagtgggcccagataaagtgtttcttattccccttggtcaagttgtccccagagtggtgctgtgcctgagcatggtgggagcactcccctcactcgtctaccactgtgttacccagagcatcatttgtggttggatggccacatcctcagctgtgctttggagtctcctgtggagctctgcttgcccttgcatctcaccctcttgcagatcacaacaggagattacctttagtttcatttttgcccataaatactgttttcattgcccaagacatgttcatttctgaggcctgctttacacagactagcctaagaaaagtttctgcttgtctagttagacctgactaaagtaatccagcacaaaagttccatcattatgtatttgaaaacagatgagcgtatgagtgtgtgttgcggtgggcaggaggagggagaaaacccaaatgaaagccatgttcaaccccagatgagaggatacaacagtctttctggtgatacattttctctagccattaaagacaactttgttcttaatattcactctgtatagggagacagagtgatacagtggaaaggcaccagactgaaaggaccctgggtccttgtcccactgagtagcaccctttgcccactcagggtcggccctgagtgcgaagagggttggaagaggctcttccaaggtgcttttcaatctcagggctctctaatccttcatggtgcccccaatgcctggatgcaggcttggttcatggtcaccaagctttttaaacaggtttacaaaggttttgttcaaggactcagtgtaacctgtagacacacacactctgaggctaaatattaaaatagaggccattggtgagatctctaaatgaggatccttgagtattcagttagacagctggtatctttcacttacataccaaagtgctttttcataggggaattcttaagactgagaatgacattttgttgtggcttttgcgaacttataaactctgctgattacttatataaaggcttttggccattgggtgggaggggaattatcatgaagaaaattactagggaaactacacggtggcattcagccaagagctggtattgatttgatttagtcacactatgtcatgtggcttctataggaccattagcgaccattgtcctttgttttaagtcacagaatgtacactgggatttcgagtctaagacatcaagctcctcttgtcccctggagggaatattcagggcactgacttaagtctagtcaagaagagtcatggtgggaaatccagcctcctctggctaagcctgctcagtccccaaagatgagctctgcaactttcagcaaccattcagacattctttatgagtcacctgccacctgcaagccactttgaggaaaatggttggtcttctcttccatgctccaaaagcccctgagatggcccctctgcgttgctgcattatgaataaaatcatcatggtcaggcgacccaagcagagcacagctgactatggtatgaggaccagtggccctgtggaaagcggtctcagtgctgactcgctgcagcttctttgtagctatgcagcaatcaagaatagtgctgagctcttgatggtggggccccaaggtatgaggccagccacaggccaagacttgctgtgtaggccttgcctgtcacatgatctgccaggccctcttcatcctccccgtggcctctcaggatcttcttccctgctgatctctcccaggctccaggatgtgtccctgcagttggttcatcccaccccagaggagtctttctaaactgtggctcggaacttgtcagttgcttaggcaccacctcctcacacttccaaggccttcctttcccagcctcgttagccactgggctgctctttctcacacactcaggtatccgccatgccacctgcccttaaccctccttcactcagcatttgcttgatgctgggtcctgggtaagacaactctcaacctattgcgggatctggccagcagtctgcaatgcaacggtgctctctctttgttcccaggcagatcggcaggtcgagaaataatagacacacgcaagatagcaaaatctgggtccaggggggtcaccgccttctgctcccacggtgccaacaacgcactggatataccggcatttattattaagtttggtgagagggcaggggaaggttagtgagggatttagggtcatttgattatgaggtgagatggtcacatggggatgaagtaattctttaacataacatctgtatgcagaagtacagtatacagggataagaatttatgatatagtgtgtgcatcagtagtttctaacagagccttaaaacagaaacacagtctttccatgacctatgattagcaagatattaatcagcagtaacagttgcagcaaaagctggttacaaacaatccatagaaacaggatgtgaagctagacaaccggttagaccagaaattctcagaagggagtatgccttaaccctaaagaggcctagaagagccgtggcaagatgagggcgtttatagccctatcttatccatatggacaggtgctcctcatgcatccgtttataggctctccacaagggtcacattccattcccagagctatgaacatctgcttttctaggataggaatcttggtgatgtgaaacctccctgactgcacgtccattcataggctctctgcaggggaaagcacatcacgtgctgttggctcattctggcagtccaacctggcattgtctttacacaatcctgcatgcaattatgtatttacaataatcaggagcatttcatcttttattccatagcaatagtttcagggggtctccctacatcaacctctggttccctctggtgctgttttctgagcacactgtgaacttccttgctggtaagggtgcttgtgctgcctcccctatgggaatgcccttttcaacccagaagtcactcagcttgtcagggtccaggtcactccatgaggtcagctggcaaggcttattcccaggggctggcccagcacagctctccaccattggttgggtggatcctgaactcctatgaggttgggcatgttgatgagccatctcccctctggactaagaggcccatgaggatggcggagaccacagtgcaaatgtggccctcaatacatgttggatgaggcaagttctatgtcaccaggagctcagtggggtttagcatccttggacatggctccacattagaacagtgataacagaacaattattgtgagctcctattgagacaggaaaatagggcctagaaacagggaacttaaggccactctgtgctaacttcctaaaagagaaaacaccagggtctggaggcaggaaatctaaggccaattcactctgacttcccaaagctggatcaaaaggaaaataccggggtctgggggcaggaaacctaaggctgattaacacaaacttcctaaagctaaaccaaaagacaaaaaccccatctctccatgctgagtaacaaaggatcagaggctactctccctacaaccatccctcttccaccacatctcagatggaaagggaggggagggtgccttgttgaccatgggccaagcagggaccatcccttcatctgcatagggtgccagttcacctcagcctttaattagccacagaccaaatccttcatccagataaggggtagtcattaagaacctcaaatagggtacttaaagcccagaaaactttgtaactgggcccttgagccacttgctcagacccactctcaccttgcagagggctttctcactttaataaattcctgctttcactgctttgttcctgcatttcattcctctgctactttatgcattttgttcaattctttgttcaaaacgccaaagacctggacaactcgtagtcaatctgctgtgctaagtgctctgctagtctgtgtcatttactgtgcacacccatctcttgggtggatattaggaatgagcccatttctccaatgagccaagctaggccatggaggggttgagccatggtgcagtttctgcagtgaagaagcaacagggccagaataggcccacatggtcagactctcagacttacaaccttactcaagtacaatgagtgttccaatgatctgagcagaagaagttgtctttgtaagcagaaaatggctgaagaaagcaaaaagagaaaacagagcagattagtcattgatgtggtttggctgttttgtccctctaaatctcatgttgaaatgtgaccttcagcgttggaggtgggtttagtgggaggtgtttgggtcatagaggtggatctctcataaatggtttggtgctgtccttgtggtaatgagtgagttctctgttaggtacaaaccaccccaaagagcttcttggtactgccaacactccccgcaaacctctccgcgctgcccacccttcccccaaaccttcttacatttccaagcccttatctaggcaccgcagtgaagccagcctgatagaagactttacctatcaggccttgctgcgataaagcaaaccccaattacaaaccatccggaccaaacggggaggttgtgggaagcataaacaaactttacctacaccctccagtaccgtaaacatcacaaggtgatatgtggcagaattaaccagcagacaaccccgggatgcagccataccaaaggactccctcaaactccctgccccaatgtaaaccccctattctgtaagcttggggctgctttccttgactgttaagggggcagccgacaggttaataaaggcttgcctgaacttggggctctctctctctggtcctttctctcggctaaccttacattctcactctctaagttcacatgagatctggttgctttaaaaagcctggcagctctttgttctctctcgccatgtgatatgctgattacccttttgccttctgccatgactgcaagcttcctgagcccttaccagaagcagatgccagtgccatgcctcctgtacgccctgcagaagcatgagccaaaataaacatttttctttataaattacctagcctcaggtattcctttatagcaatgcaaaactgactaacatataaaattggtacaggagttgggtgatgctatacagatatctgaagatgtgaaagcagctttggatctgggtaatgggcagagatatcagaagatatcagaagaagacaggaagatgcaggaatgtttcaaacttattggagatttgttaagtggttttgaccaaattgctgacagaaatatggacaatgaaggccaggctgatgaggtctcagatggaaatgaggaatttactggcaaaggtcacccttgttatatcttagcaaagaacttggctgcactgggtccatgctctagagatctgtggaagtttgaacttaagggtgataaattagtgtatctggccaaagggatttctaagcagcaaagtattcaagatgttccttggctgcttctaacaacctgtctcagatgtaggagaaaaggaaagacttaaagttggaatttataattaaaagagaagcagagcataaaagtttggaaaatttgcagcctgaccatgttgtagggaaagaaagagcattttcggagaagaaaccaagcaggatgctgaggaaccacttgctggagagctttgcacgactaaaagggagccaagtgctactatctaaaacaatgggaaaaagcccttgaaggcatttcagaaatctaggcccctcccatcccaggcccagaagcctagtgggtaagaatggttttgggggccaagcctggggccctgctgctctctgtagcctttggacactgctacctgcatctggctgatccagctccacccatggctcaaagtgccccagatacagttcaggccactgccttggaggacacaagctataagacttggtggcttccccatggtgttatgtctgcaggagaacagaatgcaagagtgaaaaaggcttgacagcttccacctaggtttcagagggtgtatgtgttgaaaagcctgagtgcccagggaaaagcctgccacaagggtcgagctcctacagagagactctactagaacagtgctcatggaaaatgtggggttggagcccctgcacagagtcatcatggtactgctgagtgggattgtgggaaggtggctgagaatggtagagccaccagcggcttgtactctgaacctggaaaagcaaccggcactcaactccaaccagtgagagtagccatgggagctgcacctgcagagccacagggatgggtatgcacaaggccttggcatcccaccccttccatcactgtgccctggatgcagaatatggagacaaaggagattattttggagctctaagatttaatgacagccctgctgggtgtcagacttgtgtggtgcctgttgcccctttcttttggctgatttatctcttttggaattggaatatttacccaatgcctggatcaccattgtatcttggaagtaaataacttgtttttttatcttacaggctcatagttggaagaaacgtgccttgagtctcagattttggaattttgagttgatgctgaaatgagttgagacttttggggaactattgggaagggatgcttgtattctgcagtgcaaaaaggatgtgagatttgttggggggtcatgggcagaatgaaacagcttgggtattttgtgcccttcaaatatcatgttgaaatgtgaactccaatgttggaggtgggcctagtgggagaggtgtttgggtcatgggggtgggtcctttataaataacttgctgctgtcctcacaataatgagtgagttctctctgtctgtgagttcacatgagatctggttatttaaaagagcctggcagcttctccttttcttgcttgctctctcactcgccatgtgatatgccagctcctcttttgccttctgccatgaatggaagcttcctgagccctcacaagaaggctatgatgacgccatgcttcctgtacagcctgcagaaatgcgagtcaaaatgaacctcttttcttgacaaattacccagcctcaggtattcttttataacagtgcaaaagtgaccaacacagtcatttcaaagttactttccttctagagttaaaagatgaggggacacgcttataacactgactcaggttgactgaaccttctgagtatttttgtatttttttttaattggcccctttgaaagttcagtataattatgtggcattcggcacaagtgaccccattctggttgggtctggtcagccggggcttagggaaggaggctagtccacagcagtggcatcccctgaagtttgtttcacacaggcccctgagttaatgagtctttctaaaggaggctttgcttggtttgcttatcagccatctttccactcttactgtagacagggacacctggatgctcataatttgctttttttttttttttttttttttttggagacagagtctcgctctgtagccaggctggaatgcagtggtgtgatcttggctcactgcaacctccgccttccaggttcaagtgattctcctgccttagcctcccgagtaactgggattacatgctgggattatgtgccagcatgcccagctaatttttgtagttttagtagagacggggtttcaccatgttgggcagaatggtctcgatctcttgacctcgtggtccacccgcctcaacctcctaaaatgctgggattacagacgtgagccaccacgcctggccgtgcacgtttttaaaaattaattaatttatcctgttgccctgctcagagtaaaatatgctggttttcttttctacagtatcttaaaagccttttgtaacaatgtttgtgagcaattgtgttaaaattattctgaattaatatctaatgcttgaacacacacactgtgcatgtctgtgtgtgtgtgttaaactcaagtatagcacatagagcctctgtaggtgataattcttgcctcttgggttccctggaaaaaggaagtccatatggaaaagagaggcagtctccaggtagagatacatcttcagggattttaaaggaaattttcagcttgtgttctataaaagcaccaaaggtgacttgtgtgtatagcccctaggttggaggaaagccttgctggtttttctttttcttttttcttttttctttttctttttctttttctttttaccttgctggtttttgctggtttcattgcagcatttcagctctcctgcaacaccactgacatttctctattgtttttctcctccacactgagacctattggctcagaagtccaccagcataaaacccagattttcatacttctaaattgttttcaacatagctcaaccaggaagattgttaggcattggaggccttcctggctttcataccctggtaaacctcaccccacatgtgctaaccatagataagatggagccttgtggttagaagacccccaagacactgtctagctgctgagaaacatcacttagactcataagctccttctccaatttccatctcccccagcagttctcttgccttcctccccatttgatggtgatcccacacccataaactctagacagtcttttactctgaggatgtccccgcttctgctaccctatccaagcaccacccaataaagttgtttgtgtggtactgcccctggttggtcatagcatttttcttgatcaaccccctaatcctgcacagtgtgcaatgaactctgctgaacttggagtctcgcacttagaggttgatgattatctgagctgaggtgtgtgattttagggggtctgtttggactgttaaactgataaggccagaaggccttagaaaagcacaccaggcaggcttctcactgggacatggaatgctgctgttgtctggtcttgaagcatctcagctttcctgctgcagtagaaaactctctgactgttttggaacccagaagtcacaaattacaataggcttgtctcgactctaagctaaaacccaaaaatgtccactctgggctgtttcagactcatgtcaagctgtgctgaacagaaagcaggcatagctcgatgcactggaggggtctttgaccctgtgatcctggtaggttttgaacacccctctctggagttagaaactgtcacaacctagatgctgtcctggactgtctgcatctcttgcagatgcccatgatgaggggattgttctctggtggggccagcgagagtggagctgttcatgaacactgtatttttgatgtagacaggttgcattttttactggtaatgctgtcaaaagctgcacattgagggagggcacccaacaggaattgtgatccctctgcccaattgtgacagatcagtcttagaccttctctctgtgatgtccactgctggtgacttgtgtccagcgatccacattagtttcagtttgggaaagtggacagacagcctggctactttctttccttgcttctggcctacaagtcaggcagtaggattatcaaatgcagctgtgcccagggagggattattattttttaaattgttgttctacactgctcactgcataaatgagcaggatgaaaaggagtaaacccattttggaatcttttggaaatgcgggatttcttcctgactgcttcctaaacatgaggggcctttctgttctcatgatgctgtatgacagtgtttttctgtaaaaacagtgtcatctctctttcatatagccctgccaggcaagaaggccagggggagggtaagagatgactgaagcaatgtaaagcttttattgttgagtgggccatgctgattttataaggatggaggaaaaagagaatgagacatctgtagaggtgtgggagaaggcattgtgatcttggtgtttcagaactattcctgaaagctttcacctcttgctgaaggaaaacaccccatgctgcctttgaaagcttctgcaagttttgtgtatccaaaatgatggccatgcctgagaccacacctgaccccaccgactaagggacagaggaggtggcccgagcttctccatgtttcccttagagcgcctccaggtgtcctctggatctgtcatgcacaagccaaactgtctgcaagggaaaccaaggatggaactggactatatagcctgtactggaaaacaggccacagtgtggtactgttaacctgtgctgcctgacttaggtacaccctcttgtgttgcccaaactatggtacactctgagtttgcagggagaccatgtgtatgctcgggtattgtacagcttatgtgccctgcctgtcatgacactgcctcagccctggatggcttccaggtcagctcgaacttcctgtccagagctgtgttttacctgaattgatgccccaattgattgaattggccaagtataaagaaaaagtactgaaatttaagagggaagccacgtgactgtctaagatacatctctttggttaatggggtttgtgttaactggttcagtacaggacccctaacaggcacaagtgacatctatatgcagcttggtttccaccctgttgtgtcaggtcctatgataattttcctgtaatatgccttggccagtggggtgcactgtgaagaaaagagttcacacagcaggcctcactgctatctttggcaaagcctgctgctttcagtgttatccattggctggattctcaggacttggatttgggagggattccacctttctcagaactgatcagggtggttcactatacccaagctgcttatgcaaacaaaaagctgcacactgctttcctcctgggagtctggaattttggttcatgccaggcagaactgcttatgtgaccagtgccaagttcaactcatgggtgatgaggttttactgagctccgctggttggcagcattttacatgtgtggtcacaccttgttgtgagggaattaagtgcgttctatgtgaccctactgggagatgagatgactctggaaacttgtgtctggtctcctgcacttctccctgtgcaccctttccctttgctgattgtgcttggtatcctttcactgtagtaagttgtcgtcgtgggtaggactatatcatgagtcccatgagttctcctagtgagctactagacctgattcagtggtctgggttcccccatttcattttggggaccctgacacacctgtccatcccttccatctcccactccagggaatttcagattaggacgctgctgagaagaatcataatggccaagcttgcttaagtgcttcttaggtctcaaggactgttctcaatgctttgcaaacatccatagattctattgttccacccattttgtgaaggaaactccgagtcctatctatgcagcttttctgtaaatccaactctgttctaaaacaaaatggttaggtttctaaaaagtaaatagtaacaagagcattggggaaagaaaccagacttgaagtaagatcaatatggcagtgaaaattcctgtaccatgttttcctgttgtatctctaagcctggagtcacagtcagcccaaatatgagaactgcacaagaggtgtggacagaaagagatctatgagaaagatttttctttactgaccaagagctaggaagagaggcctttacagcatacagataatgagggacagaacctttttatcttgcttgctctgcctccaggccagcctctgtcctgaatctgtaacctgtggcggcagcatcaaccacagctgggcaggcacataaacactccaggcagtgattcctactctctgataagaaatttcatccaaaaaccctggaaggattgcaaggaggaaatgaaaagcacttgtgcaggtcacagcaaggggcacaggctaacaaaaagactgaggcctactcataggtgtgtagaacacttcctctcctccacgccttaccactacgtggcactgaaacaactgtgcatctcaaacttcacttaaaaagtctctggggaaacccaagatgacaggggcagaccaaaaaaatggaaaccagaagaaagttcaacctctgatgcctctagctccacaaaacagtaaacacagtctaactcttagtcaaataaaaataaactatcactgtaaaggcctattttcctcaattccatttacccagtacattatatatatttttaaaaataatagaaatgtttatttatggaggtaatgttttgtgtgtgttgatttttttttattgaacaagtaatattaaaaaaatggtaatggaacacacatagtcccacaacctttacacatataccattgcattgtgtaacagcagtagcagtagtagctagcattgattgtacatttactgtgtgcaaggcacaagctgaaaactttaggagcattgcttcctttaattcccatgacgattatgtaagatagttattttactatctcattttacggatgaagaatttgcaaaacaaagataataatgggtatagtacacacttataaccagagcatgaagtcaactttgcattaagcttctttcacttagtacaatgatgtattttccatattgaatagaccattctagtatattcacatatcagttttcttctcattagacatttagatcatcccatttttcacaattatatttaacattgtagtgatcaatttcatttagtgctcgtcttgaattatttttcttaggatggggtctcaaaagtgatcttcctcaatccaaaggtaaaatcacctagctttgataataacatactaaaacaaaaaacttttttaagaaagcccacattttgtcaatgtttataaaaccaaatcattctcttcataggtttagatagtcatacatttaaaataatggtactgtaattttaaaattatgaaggtatttttatataattcagtctcattgcaaaatcactccatggagactatcttccaggcagctaggcacttcaagaaaacttccagatttatgaaggcaagacgtttctgccttcttctactgaattcacccccaaaccacaagacaatgagaaccagaatcacaactcaattttggacaacaccagaagacatttgtaactcagaactctgttgtacaagcagaggacagtggcaggaaaggtcaaaccaagtgtctgaagaaaggctcaggaacccaaggcaccagctactgcagaaggtgagcaagaagtgcaggctgaaaacaagggagttatgtgagtctatgtaagggacagagtcccccaattttcagtcctattagcaagaagcaggacggcatccttcagaaaaactgaaaagagagcctctggatatagagtcacaaggcacagagtggggcatggtgtaccagaccagacccaggggactggatgaagtctgcatcttgaatggagagacctccagatgtctggttttcaacaacaacaaaattacaaggcatagtaaaagaaaaataacataggttggaaagaatgagtatcagaaacagactcagcatatggcagagctgttttgtgaagctagaggcattggaggttgaactttcttctggtttcctttttttttggtctgcccctgtcatcttgggtttccctagagacttcttaaatgaagtttgagatgcacagttgtttcaaattgacaatttttcatttattttattttttatggacacatagtacccatagtaggtgtatgtatttatggattacatgagatattttgatacaggcatgcaacatgtaataatcacatcagtgtaaatggaatattcaccacctcaagcatttaccgtttgtgttataaataatccaattatacttagttattttaaaatgtacaattaaatcatgttttactatagtcactgttgtgctatcaaatactacatcttattctttctatttcttgtatccattaatcatgctcacttcccccttccacccccaactacccttcccagcctctggtaaccatcctgctactctctgtctccatgagttcaattgtttgtatttttacctcccacaaataagtgagaacatgcaaagtttgtctttctgtacctggcttatttcactaaacataatgtcctccagttccatccatgttgtagcaaatgacagggtctcattagtttttagggctgcatagtactccactgtgtgtaggtgccacattttcttttctttttttttttattatactttaagttctggggtatatgtgcagaacgtgcaggtttgttacataggtatgcacgtgccatggtggtttgctgcacccatcaacccgtcatctacattaggaatttctcctaatgctatccctcccctagccccccaccccctgacgggccccagtgtgtgatgttcccctccctgtgtctatgtgttctcatcgttcaactcccacttatgagtgagaacatgtggtgtttggttttctgttcttgtgttagtttgctgagaatgatggtttccagcctcatccatgtccctgcaaaggacatgaactcaccctttttatggctgcatagtattccatagtgtgtatgtaccacattttcttaatccaatctatcattgatggacatttaggttgcttccaaatcttatctattgtgaatagtgctacactaaacatgggagtgcagatatctccttcaatataatgatttcttccttttgggtatataccaaccaatgagattgctggatcatatgatagctctatttttagttttttgcagaacctccaaactttcccatagtggttgtactaatttacattcccaccaacagtgttccattttctccacatcctcaccagcatttggataaatgtcattttaactggcatgagatgatatctcactgtagttttgatttgtatttctctgatatcagtgatgttgggcaccttttcatatactgttagcaacttatatgtcttcttttgagaaatatctattcaaacttcagatcttttactcattttgaattggattattacactttttcctatagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcacttgaagtcaggaatttgagaccagcctggccaatatggtgaaaccctgtctctactaaatatacaaaaattatgcaggcatgttggctcacacctatagtcccagctacttgggaggctgaggcaggataattacttgaacccgggaggcggaggttacagtgagctgagactgagccactgaactccagcctgagcgacagagcaagactccatctcaaaaaagaaaaagttagcattttcaatcagttgtattggaacaattgaacatccaactatttaaaaaaaaaaactttcaccaaaacctcacacattatacaaaaattaactcaaagttgatcataaatctaaatgttatgtgtaaatactttaaaacctttaaggaaaacatgggaggaaatattaatggtctgaagttaggcaaagaggtcttaaacatgacactaatagcataattcataaaggaaaatatgataaattgggcctcctcataattaaaacttttgctctgtgaaaaactctgatgagagcatgtaaagtcaaccaagagattggacaaatatttgcaaatcatatggtcttttatgaagattatataaagagtcctaatacctcaaaaattagaaaatacgtgtcacaagacaaattacactatatttagctcaattatctaattggcttttatttgtgattctagaatgtgcaactgctaattctatcaaatagagtgggtgttctgatgagctaagcagaagaggttgactttatatgcaggaaagggctgaagaaaagtagaaacaagggacaaaaagttgactggtcattttgaagttgatttccttatatgataaaagtggagaaaactttctttccatgcctgctcgagcacactgggctctttgtcattggatgctgtgactctcctgtttctttttaatttttggaaaactggcccatttcaaatttcattttgattatatggcaattaggatgagtgattccattctggtttcgtctgttctgctgttgcctatcaatggagcttagtccaaaacaattgtctcccatgaattcatttaacacaaccaaccaaattttttttttgtggggggaagaggggcgccaaaagatatcaatagacacttcactgaagtgaacatatgcatgacaaataagcacatgaaaaatcattctacatcacctctgttagggaaatgcaaattaaaccatgatgagataccataatacttatttgaaaatgactgaaactttttttaaaaaaattgctaagtgctaacaaggatgaagaacaacttgaaatctcatacattgctagtgggaattatgatacaaccactatggaaaatgatttccaaatgtcatatcaacacacttagcaatcccacccaaggaaaaaagaaaagcttatgttcacacaaaagcttacatacatgaatgtttataacatttctggtcatatttgccaaaatctggaaattactcaaatatatttccatgggtaaatggaaaatgaaattttggtgcatccatactatgaaataccactcagcaatagaaagaaatgaactattgatacacaacaatgtgtagtatatcaaactcaaaggtgtcttgctctatgaaaggagccagtctcaacaagttacatattctattattctatttaccttatattcttgaaagagaaaaatgaaatgacaaagtacagatgagtggttgccagggttacgtgtgaaggggtgggtataactataaaggtttagtaggtggaggggattttggggggaggagggtgatgaaagtgttactatcgtgattatggtggtggttttatgaatctacatatgagctaaagcccacagaacagaacaccaaaagccaaaaaaaaaaccaaaaatttactgtttgataacttaaagaaaaaaattaaaaagtaagctgcagtgactatattatataattttttttgactttataagaaggaaaattaccatggatagagacattatgcaatgataaaaaagtcaattaacaaagaagacacaatagtcctgttaatttacttaaaagcagagcttcaaaatacacaaaacaacatttaatagaacttaaaggataagtagttaaatctgcagttatatttggagatggcaatgctcctttctaagtaatgatggaagaagtagacagaaattctgcaaagttgtagaaggaatggaagaacaaaatgaaccaacttgagctgattgatttttattgcacactccacagcacagcagcaggatatacaaggttttcaagtgtatgcggaattttcaccaaagtagaccctaaatgagcccataatgaatttaaaataattgaaaatgtacaaagtgtattttaaaaatctagaatggaataaaaaataaaatataataaaggagatatctgtaaagtccccatgtaaatgaaccacatatatttactgatctatgttttaaaaaaattcttgaagaaaattagaaaatattttcaaataaatgaaaatggaaatatgttttaaattttgtggaattcagctaagcgagtggctagaagaaacattgtcattaaaagcttatattagaaagtaacaaaggactaaaataaaaaatctaaactttgatcttacataattagaaaaagaaaagaaagccaaaggcaaacaaaaatatgtggatgatataaataaggagagaacaattaatgaaatagaaatttcagaagtttccaaaaaacagtaaatgatgttgatggaaccaaaaattatttctttaaatagatcacacaagctgaaatgtctgatgtcaatctgagaaaaatttttaaaacgtggtggagaagtaatggctttcaacacagctagaagtaaaggacactatatggaaactacttttttatgacgacagcactccatttttagagaaacttgtgagaaaaccagatttgccttaaaattgtctgaatttttaagtgcctactatgtgacagatgctatcaaatgcattaatccatcaaatttgaagaggatcctgtaaggtcagcatggagagttcaccttctacactccatagcattttctgcacttccctttgcaacaccatctatcatctcgggaagctgaagatttcctccttccatctgatgcaggggcagaatcttacccatcatctctgctaccctccatatgactgttcttacctgaacacatgtacaggtgccactagtcacactgaaagccagcatgttcctagaggcagatgccagacaggaggcagtggaaggctggttaattattcttttcaaattctagttggtatgtccaccaaataaccattttttcacctctgggagaagcccaggtttggtaagaattcagctttaggagatggctgcttctcttctacttcttatgagggggtggatgttctgagcaccatccatctctttgcctgttcagtctccacctttggataagaacctcattaaaatcctactgcaaatatccatgtggcttcaaaaacccactctctactttcagagctgaatctcaagaaccaggaaacctagagcaaatatcaaagtttgcagtgaaagactgaatgccttctcctaagaacagaaacaagaaaagggtttcccctctcactactcctatttagcattgtagtgggattcttaccagtgaaatcaaacaagaaatataaataagagggacccagaatggaacatattatacaacattgtttctaaccttggaagacatgcctgtctatgcagaaaatcccaaggaaactgcacaaaagcttctcaaataagtgagtgcagcaagctcacaagatagaagcccaatatacaataataatatttccatgtgatggcaataaaagtgggaagttgctcttgccatttcttcagattcactgagtgtgtcctttgctctgtccattctactgttcagctcatcaaagtcattcttcattctagctgtgatatttttcatttttagcatttccttttgactcttacagtttccatccttctgctgatattacttatctgttcttgcacattatcttctgtttccttatagccctcagcacattcctcacagttgtttcaaattcccagtcagatcattccaatatctttaccatatatgagtctgtttctaatgactgctctttctcttcacactgcatttcttgtgtattatggtttgaaattttttgttgcaaacttgatgtaatggaatagataaaaagaatggagttaaataggcatttagtgcgagactttgtgttcatctggctgtgtttactgtttgctgtagctgtaggtgtcagaagctaaacctcccttttgtgtccttcatttttcctccttggttgtgtttggttttccttggatacttgttcattatggtctgacatgtactgttctttcagtttcattgccctattgatgtggcagtgagctgtggagggagggaaaatgttctgtcctcctatgactaggtgttaggcttgaatcagtgtgcctgggctgtaggtttcactggtgcttctcagttttgttttccccttgaagacacaaaaggctggatggtgttgtaattggatatttcccttcccacaggttggttaaagtctagaaaaaacccagcaagttagactctggaaaaatagtttctcttgagttcaggccttggtaagaagaacagaacactctgggcatattttctaattaattctttccaaactccttacaggaagtaggaagagatttttccctggtcttcactgagaaaacctgacagggctcctagagagaagatgttggaaacagtggtagtccccttaacatggttcccccaagagctctcaaacttgccaatagtgagcctccagccattcatctcgtagagatgaggttttcccatcttgatacttgttcttgggtattcagctcctggacttcttatctccaaggtgtgactgtattttgcctgtttctttagctttggtctggtagtttgccctgtggtctcagttctctaagcaaatctgagaaaagtttttttttttttttcaatttattcagctttttacttgtttgtgtcaatggaagagacacttcaagtttcttataggctgaactggaaaaaagaatggacaataaacattggaaaacatattttaaaatatcagttttaatagattaaaaaataaaatgctttgctatataaccaataaaataagtccctatctgtgtggagaaatgacaaaatgctaatgaagacaattcaaagaggtccaagtaaatatatgaacatattatcttcatggactgcaagactcagtggagatgtgtgacctataccaaagctatctgtagattcaaagtcaatgctgtcaaactactagcaggaatttttgtacatgtagacaagctgactcaaaaagtgtatggaaaggcaaaggatctggaatagttaaaacaattttgaaacaaaaaccagaaaatcatggtggaatcatactgctcaattttaagatgtaatataaacctacagtaatcaaaacagtatggaattggctaatggatacacatatagattaatggaatagaatggagagtccttgaatagacccacacaaatatggccaatggagatttttagaaaggagtaaagacaattcattataaaaatgttaggcttttcaatcagtgatattggaacaattgaatatccatatgttattaacaaaaaaacttcaccaaaatttcacactttagacaaaaattaactcacagtggatcatagattcaaatgttatacaaaaaactataacgcttttaaagaaaatataggaggaaatactgatgacctgaaatcaggcaaagaggtcttaatcatgacaccaaaagcgtgattcataaaggaaaaagtgataaattggattcctcaaaattaaaacttttactttgggaaatacatggatcagagaataaaaagtcaaatgtggagttacacaaatatatgcaaattgtatgccaaacaaaagtcttttatgcagaatatataaagagtcctaaagtttcagaaatgagaaaatgtgtcaaaagacaaaattacaccaaatttggttcaaaaatctaattagctttcatttgcaattctatagtgaacaacttctcattctatttaaatagaataggtgctccaatgagctgaacataacatgttggctttacatacagagcagggctgagaaatgtacaaacaagtcttcagcctgggccccattcccaggtaagtagctgaattggggttttgtcttggaaattttccgtaatggctaaaagttaagattagcaagtagctggtcttaatttctacttaccaatagagtactcggtaatcctgtgctatcttttgttttgcttaactgcctttctgtttttcagtttgttttttttactgttgtttttgctgttttagtctttttcccaatggatttggccaactctactggacttggtcaaatccaaaggaaagttccaaattatggggaacaaagtctctgaattggctaaaatcatgcagctgaaaaaaaagaaagaatttgattaccttaggtgcattatttacataacaaggccaccttttagtagccaagccaaattgaaagagcaatggctgtagttcagtagctaagattctgctcttttttcacatgacagcctcggtttggttcctaaatcaagtcctttctggtttgatatttttgttacatttgaactatcagcagtttatcccagccaaaatatggtaatgagatttaacgaatttttttaagagcacaattattatgtcagcttaattaaaagctaagatccaagatgtatatgtgtgtgtgcctctgtgtgtgtgtgtgcctctgtgtgtgtgtgtgtgtgtgtgtgtgtatgtgtatgttcagaacagggatctctgagaaaaacagaaacaaaaatttaaaaaggtaaatatatatgtatacacatacacctacatatatattatatatgtgtgtgtgtgtgtgtgtgtgtgtgtgtgtatgtatatattgaaaaggcctttatgctttctttctcttctagaatattattttttgagaaaaagcgttttttaccattctcagtcaacggaattctgttttctccatttacttctgccagtctctttcttcttgccaccgtctgctgcatgaggggccttaaataatttcagggtctgtgaaattagatttttttctaatttcagaagcgctcattagagctctttagatttaatttttatatatttaattatatatttatatattgatttataatctatataatttaattttatatatgtaattggcttacagacaaaaaaatcacttaaatcaaatactttatcagaaaaataggagcccaaatgcttttataagcttacttaagtaaatccttaataaataagttggttttaaaattattggtaaaataaaattagaaatttcttcagaatggtcaacatacattattgttggattcattggtctagtagtttaatatttaatatctgttaggtgttataagttgtcaaaatttcgcaggagaattgtaaagcttgcagcccacaagagaattatttttgtatagttttttataaataaggcactgaatattgttgagtttaatgggaacagctaaatcttgaatattggcaaaatataccatttttttaaccttaagattcttactgaggtaaatacctgaaatgcacgtgctataaaatggttaatagggatataactttaaatgatgactatcacaattttcataaacaatctagttaaacgattgaaaaatacaattaattaattgattaggaaaatgtaatgaaataaatgcttgcaaataaacctcacatagtttagaatctaaagttgtattgagttaaataatagatattcattaaatggatcatttccaatttctttaaaaaaattatggggaaacatttttcataaaaaatgtgttcttatttaaagggaaataagtttagtctaaatttaaatgttatttaatggttatttttgaaacaaggtaaaaggaaccagtaaataagagagatgtaaagaaagttatagatataataagatattttggtaagaaaggctaaaaggagactaattttatataaaatgaatcttgcatggtaaattttttgccctaaaataaaatgactggttatttaagaaaaaggttgtttaggatacaacaggaggtccaagaatgttgtaaatggtttctctaagccataataaagtttgtaaaaagagcattcataagacagaaactttatgtgatcaagttggctataactaaaaagaaattatttataattgtctttctagagattgggtattgataaggaaaaaacactaaaacactaaggaattggttagaacaacaacatttttaaggtattgatttattattaataaaattacaagggattttaattttttaactcaaaagctcaactgttattgcatctcactgttttcagctttctctcccctttgaaaagggctgagataataactgtctcctttaactttttcgtcagctcctgtaacctttttcctcaggttttaactgctgttgtggactgatgctgaaagtgtttcattttaaaggtctaaaggaaatgttttcttccagtatgatattctgtgctcttggctttaaattctatgaaactaagaattttcacttatgacccaggacacactctacctatttctaagtactattttcattagttctgacttgcaggttatctaaaaggactccccataggaaaagcattcacactgcagaaggttgttttttgttttttttttaacttttggtaagtggcctaacaaacaaattttacattttatcaaaataattcctatgtcattgttactatgttttgatttcctcaggaaaactgagataaaaaattaagattattacatccatgtaagtttctgtatttctttttttttttttttttttgaggcgaggtctcgttctatcgccagtctggagtgcagtggcgatcttggctcactgcaacctccgactcctgggttcaagcgattctcctgcctcagcctcctgagtagctgggattacagttgcctgccaccacgcccagctaattttttttgtatttttagtagagacggagtttcaccgtgttagccaggatggtctcgatctcctgacctcgtgatccgctcgcctcggcctcccaaagtgctgggattacaggcgtgagccaccatgcccggccagtttctatatctcttttaaagtcctagtgctattaagttacagggctttgattcctgggactaaaaaggatgccaagtcctgctaaaagcaaaagatgaggagaggaaggagcccagggaacgagagcacaggatgaacccaagttcactttgattatgtggcagtcagcaccagtgtttccattctgttttggtctgtttttctgggacctggggatagaccttagtccaaaacaatgcctcttaagaattcatttaacacaaacaaccaaattttgtaaatgggcaaaaaacatcaatagacacttcccctaagtggacatacacatgacaaataagcacatgaaaaagtactgtccatctcatctattagagaaatgagaattaaaccatgatgagatagcataacacatatttgaaaatgattttttttttttttttttttgagacggagtctttttttgagatggagtcttgctcttgtcgcccaggctggagtgcagtggcacaatctcggctcattgcaacctacacctcccggattcaagcttcccctgcctcagcctcctgaatctgggattacaggcacctgccaccacgcccggctaatttttgtacttttagtagagatggggtttcgccattttgcccagtctggtctcaaactcctgacctcaggtgatctgcctgcctcggcctcccaaactgctgggattacaggtgtgagccactgcacctggctgaaaatgactgaattaaaaaaaaaaaaaagatattactaagtgctagcaaggatgaagaaaatcttgtatgttgctagtgggaattgtgaaatggtacaaccactgtggaaaatgatttggtaatttttttttctagttttgcagtttgtactgcatttattgtttaaaaaccttttatttaattattttttgtttcttcccaacttttatttttgctttaggggtacatgttcgtgttcattacatgggtaaattgcatgtcatgggggtttggtgcatcgattttatatcactcaggtaataagcatagtaccacataggtagttttctttgtttttgattcagagtctcactctcttacccaggctgtagtgcagtgacatgatctcggcttattgcaacctctgggttcaagcaattctcgtgcctcagcctctcgaatagctgggattacaggcatgcatcaccacgcctggctaatttttgtatttttagtagagatgggatttcaccatgctggccaggctggtctcgagctcctgacctcaagtgatccacccaccttagcctcccaaagtcctgggattacaggcataagccactgtgcccggccaagaaaggtaggtactcccatctctacccttaagtaggccccagtgtttctttttccctcctttgtgtccgtgtatactcaatgtttagcttccacttacaagtgaagacatgtggtatttggttttctgttctgcattaatttgcttaggataatggcttccagttgtatcgttattgctgcagagggcattatttctttcttttaatgatgcataatagtccatggtgtatgtataccacattttctttatccagtctaccattgacagggatcaaggttgattgcatgcctttgttattgtggatagcgctgtgatgaacatttgtgtgcatgtgtctttatggtagaacaatttgtattcctttgggtacatacccagtaatgggattgctgagtgaattagtagctctggtttaagttcttggagaaatttccaaactactttccacaatggctgaagtaatttacattcccacaagcagtgtataaatgttccctttcatcacaaccttagcagcatctgttattttttgactttttaatagtagccattctgactgttgtataatctcattgtggttttgatttgcatttctgtaatattagcaaggttggacactttttcatatgcttgttggccacttgtatgtcttcttttgagaaatgcctactcttgtcctttgcccaatttcaatggggttgtttgttttttgcttgttaatttgttaatcttccttagagattgtggatattagacttttgttggatgcatagttcgcaaatattttctcccattctgtagcttgtctgtttactctgtttatagtttcttttgatatgcaaattaggtctcatttgtcaatttttgtttttgttgcaattgcttttggaatctgcatcatgaaatctctgccaaggcctagttccagaatggtatttcttaggtttccttctaggatttttatagttttaggtttttgaattaaatcttcaatctagttttagttgacaaattaaagattaatccatcttgagttgaaactggaaggggtccaatttaaatcttctgcctatggctagccacttattccagcaccatttattaaatagggagtcatttcctcattgcttgtttttatcaattttgttgaatgtcagatggttgtatgtgtgtggctttatttctgggttctctaacctgtttcattggtctatgtgtctgtttttctaccaatatcatgctgttttggttagtgtagctttataatacagtttagagttgactagtgtgatgcctgtggctgtgctctttttccttaggattgctgtggctatttacattctttttttggttctgtatgaactgtagaatattttttttctaattatatgaaagatgtcattggtagtttgatagaaatagcattaaatcagtgacacatatacaccatggaatactatgcagccataaaaaagatgagttcatgtcctttgtagggacatgggtgaagctggaaaccatcattctgagcaaactattgcaaggacagaaaaccaaacaccgcacattctcactcataggtgggaattgaacaatgagaacacttggacacagggtggggaacatcacacaccggggcctgtcatggggtgggggcagtggggagggatagcattaggagatatacctaatgtaaatgacgagttaacgggtgtagcacaccaacgtgacacatgtatacatatgtaacaaacctgcacgttgtgcacatgtaccctagaacttaaagtataatcaaaaaataataataataataataaataaataataaaaagaaagaaattataaaaataaaaaaattttaaaaatcagtaaattgctttaggcagtatggccattttaacaatattgattcttcctatccatgagcatggagtatttttccattagtctgtgttaactccaatttctttcagcagtgttttgtcattcttattgtagagatctttcacttctctgattagttgtattcctaggtattttataatttcatggctgttgtgaatgggattttgttttttatttggctctctttgtgaatgctgttgacgtatagaaatactactgatttttgtacattgattttgtatcttgaaactttgctgaggttatttatctgatctaggagcttctgggcacagactatgaggtttcgttggcataaaactatatcatctgctaagagagataatttgacttcctctcttcctatttggatgccttttgtatctttttgttgcctgattgctctgactaggaattctagtaccatgtggagtagcagtggtgggagtgtggatctttgtcttgttccagttctcatggggaatgcttccagcttttggccattcaatatgatgttggctgtgcgtttttcatagatggctcatattattttgaggtatgttctttccatgcctagttggttgaaagcattttccaatgtggacatatacatgacaaataagcacatgaaaaattattctacatcacagctattagagaaatgcatattaaaccataatgagatatggtaacatatatttgaaaaagatatttaaaagacatggcctggcactgtgactcaatgcctgtaattccagcactttgggaggctgaggcgggcggatcacttgaggccagtagattgagaccagcctggccaacatggtgaaactccatctctactaaaaataaaaaataaaaaaaattagccaggcgtggtggtgcacgcctgtaatttcagctacttcggtggctaaggcaggagactcgcttgaacccaggaggcagaggctgcagtgagctgagatcacaccactgcactccagcctgggcaacagagtgagactctctctcaaaaaaaaaaaaacgacaacgacaacaacaacaaaaaaccattactaagtgctaccaaagatgaagaacaattttaaatctgatatgttgctagtaggaattatgaaatagtacaaccattgtggaaaatgatttgatggtggtggctccctaaatctacacatgggctaaggccacagaacaggacacataaagaaaacaaaattactgttaatttaaataatgaaattaaaaattaaaaaaagaaagttggagtgattacattgagtaaacttttaaaaactttataggaaggaaaattaccatggataaatagggacattatgcaatgataaaagagttaattaagaaagaagacataataatcctgttaattcacctaaaagcattatttcaaaatacacgaaacaatttctgatagaactgaaaggataaatagtccaatctacacttgcatttggagattgcaaaactcttctctgagtaaatgactgaagtagacaaactctgcaaggttatagaagaaactgacaacacaaagaaccaacttgatctgagtggcctttactggacactccacagaataagagcagaatgtataatattttcaagtgtgtgtggaatttttaccaagatagaccattaaacaacccataaaaaatttaaaacaaccgaaattgtacaaagtatattttaaaaatctataatgcaataaaatgtaaatataacaaaggacatacctataaagtccccaagtatttttaaataaacaacacattgttactactctatatttaaaaaaattcttgaggaaaactagaaaatattttctgataaataaaaatggaaatatgatgttttaaaatttgtggaattcggttaaggtagtgcctatggaaacgtttatgtccttaaatgcttacattagaaagtaacagagggctcaaataaaacatctaaaatttgctcttaaataacgagtagagggaaagtacattaaaactaaggcaaagaaagagatggggtggtatagataggaagagaaaaattaatgaaattaaaatttcaggaatttcagggaaacaataaatgaactttataaaaccaatagttagcttttttgatagatcagacaagtcctagtgtctgatgtcaatctgagaaatttaaaaaaatattgttgttgagaagcattggctttgaacacagctagaaataaagcaactacatacaaactataatttgtcttgataactacacccttaatttatcagagaagtttctgagaagaccagcttttgtttgaatttctcttaatttgtaagggactgctatgtgtcagaagctttcaaatgcattaacccatctaatttgaagataatcctgtaaggtcagctgggtgagttcaccttcttcactccatagcattttctgcacttccttttgcaacaccatctgtcacctcagtaggctgaggatttcctctttccatctgatgcaggaatagaatcttacccaccttctctgctaccctccacatgatttgttcttgtctgaacacctgtataggtgccactagtcacactgaaagccagtatgttcctgggggcagatgccagacagaaggcagtggaaggctggttcttttcaaattccagctggcatgttcaccaaggaacagtttcttatgtcctaggaggagcccaggatttgtaagaactcagcttcaggagatggctgctcttcttctaccttttatgaaggaatgggattcctgagcaccatccatttgcctgttcagtccccagcttcagacaagaagctcattaaaaatccttctgcaaatatgctagtggcttagacaaactactctctacattcagtgctgtatcccaagaatcaagagattatgggcaaagcagactccactcacaccccattgggaaaacaaagagtatttagaggactcccagggagagaggacgaggtgtctaaagtcacagtccagaatggctgtggctatgggacaggactgagggtgcgtggtggaaaagtcagggaacttttgcagggctaggaatgttccacgtcctggggagggcaggtgattctgtgcagcctccagaggtagcagggaagagcaagcagcgggctaggttcccagaggtggaacagagggtacatgagggggaccagatgaagggtgttgtaactcaggaaagtgttggagccagacagaaatgctggctaggagtgtacttgccccatgtgctgaaggagagaatccaatatgtggatgagcacttgtaggctttcccataacgtgtttcatagtaggtgctcaacagaaagcacccaacagtcagctcccaggggaaccatcatgcccctaatgctgtttgattctcattgtcaccttcttttggcctgcttttactaccttggcctgagggtccttctttttgtcacctgagagacatgatgcagtgctgagaaatgaactacttactattcaggaggtgggcctcaggctggcaggaatgggaagagcatgagctccagaggaatcacactagagatctggttccagccctattactagccatgttatcctgggaaatgcccaagccctgtgagccttgggttcttcatctgtgaagcaggtgtgataagccctgttcaacagcactgttggagtgtatgcaatgtaaatgatgcacctggctcagggcctggtgtaatttagaagtttaaagaatggcagatgactatatttctactatttgaccccaggccctagcactctgagattttgttcttgttgatttctccaggacttatcagaaaatatgcagcttattaggacctggaagaattacttagccaaaaaaagaagttttgtcaatgaatttcagtaagtttacccactcagagggtatacttcaaaatttcagtgtgcaggggtcttcctcaactggaatgcaactcagagctcctagaatatgagtcaagaataaactccttccctctcagcttcttttccatctaaaccactattttcattcattatatcaccaccccaaatcttttcccttgttttaactggccaaattgcacttcagataagctagttagaatgtctctttaatagagtcagctctggctcacacaaccaggaagaaaaacacctggccagtggcatctgagcctcacatcccaggagattcacgcttctctctaaggaaacccttccggatgatgggtatccatcatcaacttcgtgtgccgtgttcaactgcactgagacaagagtgcaggacacctcccattcctgccccaggaggagatgcctctctgtttcatccaccatccaaaaggaactgctgagcatgtttcccttccaagcttttctctcgtcctctgagaatctggctctggccccaccccgcttcattagaatcagctcgcccaaaaggtactgcagtttcccaaagcccaaaaggccttggttcagggcatgtacactccaccacttcctgttgctccacacgctcatccctctcttatttttcctttagatcttagaggatacctggccaccttagttatgtggctgcagatactagactctaccaccctaaggtcaggggtgggcctggcttactgtagcatctccaatactaacccagggccttccaaatagcggaagctcaatgaatattttgggaaaaaatgagccagtgagcagggggacttatttattcatatttaattcaatttcattctcaaagaagccaagcaaattcaggtacatagggtacactaagaggtacaggtaaggcaagaattaactattgtttaatttctttatgtctttatctcatgtattttactgctatgttgtttcacatttctaaaaaaaccttaatcctctgctcttgtagtgtctgaattcaagaaataacatgggtttcccagtataaatgaaaagcaagactcttactcctaaactatataaaaagcagtaagtctgtctactgtcatacataaaatgaatgttgaagttcattacaccatccattagaaggaacattggaacaattccaaaaggaaacaaagataaacctccaaatcgcccaatagaacaggaactgagagatggtccacactgtgttccctcacacccaacatgctccccactactgagaactgtgactgctctcttcaaacacagagtgaagaatgggcctcatgtaacagagcagggaaagtggtggatgtggccctggaacgtgcactggcccaggccctcccacaacctgccccactggccctagctgcaactcctgctcaaactcctttctcctctcccaaagcctcttcatgcagggatgggtaggaaatgcgaactcttgcattgaccctgaccacatgctccaggactttcacatagctggtttcagcaagggcccttggaccccacaggaactcgtagcgcacaggatcactgccgggcgcctggcggtactccaggtagttctcctgcacccactcttgggtgagcagcttcctgagcttccaatagacactgtgctccctcccatcatacagccccatcacactcaatgcttcccagattgcctcctccggggcgcggctgccctccattaagatcatgcccaggacgattatcaggaggccggtcttgggcgtactctgatcatcacccagcaggccatcataggagaggcccaggcaggtgacaaggatgtaggagtggccggcagggtccacttccttcacatcaatgccaaagatcacctgcatgcactcagaggctttgctgaagatatcaggaaagtggttcttgtaatttttgatgacactctcaagcatttctgcctttgtgaccggctccttaatttgatatttgcggagcaggaaacgaactaactcagccactttctcatcaagtgcttcccggaacagggactccaggtgagctgggtccggggaggtgcttggcccctcctcttcattgctgctggaaccctcatcggattggctccacagagtgctgtcggtgacagtcagggaagaggaggcaccctcaggactctggggaggacttggtgacccagaatcagtcacctcctcaagggttcccatgatcagagtagaggaggaggatgcagccttctgctcctcagctgtgggaatctgcacatccataagccctggtgcctctccttgggcctgaaggccttcctcagccttgtagcgctgactcttctgcccaagaagcatgatgactcaggtcagggcagcaggagagtgtgggccggagctgggcaattgagacccacaggcctggggagagaggaagcgtgtgagaggcctcagctgggtactacaccctggatgccctaacaaaggtctacttacaggtcttcttcagtgcttctctggggcctcctgacctcctggctggcctgttctctgcgaacctgaaggagaaattgagagggcatctcagggtgcagcctcctggcaaaggccaaggctccaggactgacaaaagggctggtagggccaggaactgtggggttcctgctgttctgatgccagaggggcctctggtatacatacaggggaaacaccacctcagcttgactgctactactgcctgggcctcttatgctctgtgattgaagatactgcctcagaccaagacctcacagcctggttcctggagctcctagaagataaatcgaggggaactcaggctgcagactgcaagcacagccccagcaccccagtgctgtcaggagggtgagcctgactctgtgagctccccactattttgtgtggatggtcctttctgtgctcattcagggccctcatctttctcctggcagggcctggatctggcccttttgctggcctgagaaactttcagatcaagagtttatatccctgatatggaagacaaggatatgaagggacccacatctggccccacatgcccaaggcctcctgggaaaaaagcaatagctacacaaaatgcaatggggcccacgtgtcctgtcctagggtgagaaaaaagcaatagctacacaaaatacattggggcccatgtgtcctgggctgacctgaggccacttccttaatccaaggacctatctccaggagacactggaagagcaaatgaggggattccatccacccacctttccctgcacttcccatggctgacagaaggtgcagggtggggttcggtcctgtgtgtttggtgagtggtgtcctctgagtccctgactcctggcagggccttggacccccgctctgctgacctgaatgcagtgccctcagaccaaggccttcttctccctgagaccaatgagtctggtataacacaggggcctcagctgatagtcctgctcatgctctcaggggtgacaaaagaggccgggcagatttctgttgggcccccatctgttttttgcctgctaggagaaccatcgagggtaccctcaatcttccctcagtgttgtcacctagactcttggtagattcttggaccactgagtctgttgcccacatgggggtccctgttttgtcctgagttgccctctgagaacaaggtcctcacttccctgagatctcaagagagaaatgaggagccaccacatctgatgaccactgggtggggtgtccaggggtgacactaggatctgtccctacttgttcttgagtggtgggttctaaggtcttcagggggttattcatctttcccctgatggagcccgcccttcctcaacccacaacaccctgatatgagcagacatctccccttaccaccaagaccttatcttcctgcgtttccccaacttcctgcccacagtacagatgagatctccacttagggccacccttgatcgggttcccccagagataataaccaaagttagccagactttgtggggtcccttctttccaggccaggagtacccccattcatcacaaagtgagcacatcttgggtcctgcagatcctgtgaccccgtccctctgttgaacaggtgtggctccctctgctgagctgaggacgcccttcagacccaggttgctacctccctgagacccaggaggcagaagtaaggaggcactacatggacaaccctgcatgggattcccacggctgacagaagtagtaggtttcatggggtctttctctgtctgggtgtcatccaggtattcatatttactccacgacaaggcatggccctttccttcctgctgaaccgtggatgtgtcttgcatgccaaggccaccatctccttgaggccccctaccagaaagtgggggggccacatcccttccccactgtcctgccttgggtgcccagacctgagagtgggagcaggtttcctaggccatgatgggaggtctgctgagtcctccttaagggctctggggcacctctctccagtgatctgagactccactcctcagaccacagctgtctcctttctgacaccctgaaaatgcagcaaggatgcgccacatgcagccacagatcctgggacttcccaaggctgagatctccactgatctggagtccaaggacccctgagtcctccctcttcttcttctccttgactcctggcagggctgttcaccacccccctgctgacttgagtttcagtccctcggattcctgaggccaaatgtggaggcccctcagtctcagacaggtagggtgggccccctgtcctggggtcctgggtcccctcgggcctcctcatctcccagcatagcctgggccctccctctgctcctcttgagtccgtgctcatgaagcccctttgctgcatcagccccggatgcggacgtcagaatcagcgagcccggccgccatgcccggccgccatgcccggccgccatgcccggccgccatgcctagggcttcccagggctgacagtaggggcagagatgtgctctgtggagcctcagccctccctcagggtcctgcccttgatgcctggcagaacctgggccctgccctctgctaaccagccctgctctggtcacaccaagctctcactccagattcccctggggcttaagcgcagggctggcgaggggtggcccagccagacaagtctgccccctggtggtccagggctggcagcaggggcggcgctagattattttgggtcctatatgaggggtgggggcctcctcagtcctccctcagggtctcaccttgcctcctcacagaccctgagcccgcttccctcagccgatctcaagccgacccctcagaaccaggccctcgcttctctctgatccccgcggccacgtcagtggcgtcacatccgtccacccagggctcacctgggtggacaacaggggcggaaccggattctagtggggcgggggatgagggaggagcggttcagtcatccctcaaggttctcactttgagatctggcagagcctggagctccgtactctgctgatggtgtctgcttccctcagaccaaggttctgattccgagtcccctgaggtggcagtggggggaagggtgtggtggggggacaaggctgctggggtctttcagggctgacatgagggtctgagctgaattatgtggcccctctatgtggtgtgggtggaccctcagtcctcactcaggagggtcctcttcttgactcttggctcttttaggagatactctgtttctgtcacctctgagcatttgcacagctgcaccccttgcagagaatggctgcgggtcccaggccagattctccctgtgggtttgcagcacctaagattgtagtgacctctgggagaagaggcacaccttcccacgggggctcttccccagctagaagaggattttgcaaaacttttgtactaaatgatttatttttacactgaagaaactgagtagctgcaataaatttgtggaagtcctgagttttgaagttacctaacaattcctattccactttagtgattttcataatttaattcgcattcgtatagtaagaaacgaattttaaatctatgccaattgtatatgtgcattatatttatgtttatatgcataaacacatatgtatgtatatgtttatattatatatgtgtaattatatgaatgtatgtgtatatatctttacatatatttatacatatatgtatgtcgactatacgtacttattttatcaaacaatatctactcatacaatgtgtgattcactcatactattctatttctagttcattatatatatttgattaaaataatagtattttggaaggtagtcctaacctactctttgtttctagttgttattagcagaattctggagccatggtgtctcaatcaatccaattttcctggtgtcctgatattacccctgggctactggcttcgtgttttgaggtgcagactcggatcctacattgatgtggggtggtcctttaaaacttttcctgcaactcaccctgtcgtctgcagtggctgcagacctcctcaacctccctgcctctccaactgcccagaacacaagtaccagttcaacacagttttttccccagggttttctatgttttgttgtttagactttgttgctgatattgttgttttatttttctttttcccttctatatttttacacagttgattttgggagtagagcacagcagcctgggcttgattgtcactttggcagctacaggtaggcattaactgtttatttaatttaagtaagatttacacctttgctgtattctattcctcatcagtgaacatcatatactactccatttatttgggaattttttctctgaatctgtcagcaaacttgtacagttgcttctgtaaatgtcttgcatattttggttaggcttcttcttctttatattttggatttaaatgctgttggggatggtatatttttcattttatgttctaagttgctcatctgtgacaagtctcttgtattcgctgcagtggtctttgtatgctgtcttctgaagtctcttattcatttgaatgttccatgtgtctcttcctttgaattttcttgatggtcatattgtgaaaaatatgatctatttcttttcaatcttcatacctctttttcatcttgatatccatagctctctttttcatttcagcattcactgcagctgtgaacggtagcagtgaaagcatacatcaatgacttgctcctgacgagaatgggaatgcttctaacatttcacattcaagtatgtttcctgtcagttttagaaaattaaagtgccttttaatcttcatttgctaaaaatgttaatttgaaaatatgataaaattcatttcagaggctttttctgtatttttattccttgcatacgagctgcttgttcattagtccactgttgtgttgaatatacaattatctatttaggacatttgctgcaatatgagtgaacacttggctcatatgttctttttataaaggctggatgtctttatctttttttcccccccaatgcaggagaaggagccttggagaattcgttgaataattgcccgtattttgggattatttggaagagttaatatggtgattcgttttccctgaccacttgggggaactgacccacaaaactgcctgccttagaacggtagagggtggattgagctttaaatacattttcagtttgtggacgtaccattggttttatccattcaccaattggaaaaagtattgattgtcaatttcaaataagctgctatatatgtttttgtgtacgtgattttgtgtgtatgaacctgtttccaattttccttgataaaacctaggagtacaattgctgtgtgtaatggtaagtctaagttttgctatattagaaatagccaaagccccttctagagtgaatgtgttctttttcttctctaccagcaatgaaagagaatgccacatcttttgtacaatttggtattttcaggttgttgcattgtatcaattgtaacaggtgggtagaagaatgttactgctgtttacatttgtatttttattgaataattatggtaatcatcttttcatatgcttttttgtgatctgtgtatcttcattggtgaagtcttgaaatcatttactattttattggactcttcatttttatgtggttgcatgttataaggtgtttattcattcagtatatgaatcctttatccgacacggggtttacaagtattttctccccatttttggcttttttccccattcctttaagtgtttttttttttttagtaaacattttagagtaattttaaatttacagaaaagttgcgaagacagttaagagggttttcctatacatcatgtccagtttctcctattattaacatcatgcaataatatgatacattcttcataattcataaatcaatattcacctgcacattcctgtcattgtttgaggatcccatctaggataccatgctactttagtctaagctgtgatagtttctcagactattcttgtttttgatgactttaacagttttggggagtatcgatcaggctatttgtggaattaccctcatttggtatttgtctgagttttttcatatatagacttgagtaatggctttggggtaggagaccagagaggcgaaatgccattctcattacacgatattttagcaacatgactcatcgctgttgatgttgactgatgaactggctgaggtagtgttgtcaggatttccctctgcaaggttattacattcccccctttctgtattgtgctttataaaagaaagtcactaagggcagccattgggtagtagggaagtatggtccaccttcttgggaaggggtagtattgacatgaatgatttgggattcttctcaatgggagatttgtttattctcccccattatttgtatttatttaaccttcaatttgtctcggctgaactcatggtaatttattatatgtttggggttataattcaacaccacttttattttgctgctcagattgttccatctttgtccattggaagctctttcagttggctctgatgtccccttcacgtaactgagccattacatttgtttgtagctctgtcttactttatggtatgacaagatgatgcaggctcatttttatatttcctgttccagtcatagaagagtcaattttccatggtttctgcttccttttatgggagaagagtattggaatgtgagaggtgggtgcttggcatgctcattgttcctgaggatttgttattcctagccacctcaattctcagagtaaagatatatattttggtatattaacctgtgtatatacacatatctataatcagaattcttaaacccagtccctgtgagaaatagctttagaagccagacaatactgcttcagtacagtttcttttaacttcggtcccagagactaacttccacaggtacttaggacagcaccatatccccagatactcattagaggttgtttcatagatttgtaacacagttatattgttttgtcatattctatactccaccttggcattcctcgacctcctaattttttcaattttgcatacattgaggtttactctttgtgctttaaggttttatgctttttgacaaatgcataatatattccattttttgacagcatgtcatcaaccatgacatgacaaaatcaatcattacagtagcctagagaatagtttcacctgtctaataaattccttctgcttatcctagtcataccttttccccacccctgatccctggccacaacaggtatttttactgtcgttatagtcttgtctttccagaacgtcaaataaattgcatcatatactatgtagtcttttcggactggcttcttttacttagaattaagcatttaagatttattcatgtttttgtgtgcctagataagtaaatattttggttgatgaatagtgttctgttgttgttggaccacagtttgtttattcatctgtctcttgaagaacatctttgttgtttccagttttggccaattattaaataagctgccacacccattcatatgcaggttttttttgtgggcataaatttgcaaattagttcaatgtatacctaggagtgtcaagaatttgttcagctttgtaaaaaaatcaactgacaaaccatctttgaaagtggctgtactactttgcattcccaacagcaacaaatgagagttccttgttgccaggaattggtattgtcagtgtttggattttggacattctaataagtgtgtatctttgttatttaattcataattctctaataaagaatgacattgactatgttgtcttatgcttattttttatgtgtacatgttttttgttaatttgtctgttcagagcttttgcacatctattaatagagatttcttgtttgttttcttatttacttttaagcattttctgtatattctgaatagttctcattgtttagttttatactttctctgtagattttggatacaagtcctctatgagatgtatgttttgcaaatattttcttaaagtctgtagcttatctttcctttttcttaccagtgccttttacagagcagtagttttgtttttaatttttagaatgtccaccttttcaattttgtcttctatgggcatgcttttgatgttgtatgtaaaaacccatcaccaatatcaaggccatgtagatctccatttatgttttcctccagaaattctataattttacattttatatttgagtctgtgaagtattttaagataattgtttgtgaaagttgtaaggctctttctaggttcatttctttgcatattgatatgcatttgttcaggtaccttttggtggaaagactgtcatttctccatagaattgaatttgcacctttgtcaaaaatcagtagactatatttgtgtgggtctttttctgggctctatttagttccattgatgtgtatctgttcttttgccaatagcatactttcttgattactgtaggttgacagaataactgtatatcaaagctaacatcaaccatgagaaaccattcatatgtctagtgatttccttttatatgatgtaatgagaatgacattttacttctgagatcttctcctaaatgtccctatctctattctttttttttttaatttttattttcagttcaagggtacatgtgcaggtttgttacataggtaaactggtggcatgggggtttgttgtacagattatttcatcacccagctattaagcctagtgcccattagttatttttcctgatcctcttcctcctcccaccctccaccatctgagaagcaccagtgtgtgttgttctcctctatgtgcccatgtgttctcatcatttagctcccacttataagtgagaacatgtggtatttggttttctgttcctttgtgagtttgctaaggataatggccgccagctccatccatgttcctgcaaaggacaggatctcattattttttatggctgcatagtattccatagtgtatatgtacaacattgtctttattcagtccatcattgatgggcatttaggttgatttcatgtctttgctattgtccatgatgctgcaatgaacatacatgtccttgtgtctttataatagaatgagttatattcctttgggtatataccaataatttgattgctgggtcaaaatgtatttctgtttttaggtctttgaggaactgccatactatcttccacaatggttgaactaatttacactcccatcaacagtttataagcattcctttttctttgtaacctcctcagcatctgttattttttgattttttagtaatagccattctgactgctgtgagatggtatctcattgtggttttgatttgcatttctctaatgatcagtgatgttgagcttttttttcatatgcttgttggccgcatatatgttttctgtcttcttctgaaaagtatctgttcatgtcctttgcccactttttaacggggttgtttattttcttcttgtaaatttgtttaagttccttatagacgctggatattagatctttgtaagatgcatagtttgcaaaaatttcctctcattttgcaggctttctgttcactttgttgatagtttcctttgctgtgcagaagcgttttagcttaattagatcccatttgtcaatttttgcttttgttgcaattgctttcagcatgtttgtcatgaaatctttgcccattgctatgtcctcaatggtattgtttaggttattttccagggttttcataagttttacatttaagtctttgatcaatcttgagttaatttttgtatatggtataaggaaagggtctaggtttttttttttgtttgtttttttttttttttgagacggagtctcactttgtcacccaggctggagtgcagtggcacaatctcggctcactgcaagctccgcctcccaggttcacgccattctcctgcctcagcctcctgagtagctgggactacaggcacctgccaccacgtccggctaagtttttgtatttttggtagagacggggtttcaccatgttagccaggatggtctcaatctcctgacctcgtgatccgcccgccttggcctcccaaagtgccaggattacaggcacgagccaccgcgcctggccagagtccagttttaatcttctgcatatggctagccaattatcccagcaccatttgttgaatagggaatcttttccccatatcttgtttttgtcaggtttgttgaagatcagatagttgtaggtgtgtggccttatttctgggttctcaattctgttccattcatctatgtgtctgtttttataccagtaccatactattttgattattatagacctgtagtatagtttgaagttgggtagtgtgaagccaccagctttgttctttttgcttaggattgccttggctatttgggctcttttttggttttacataaattttaaaatagttttttttctagttgtgtgaagaatctcaatggtagttcaataggaatagcattgaatctacaaattgatttgagaagtatgtccatttttatgacattgattcttcctatccatgagcataggatgtttttccatttgtttgtgtcatctttgatttttttgagcaatgttttgtagttctcattgtagagatctttcacctgcctggctaactgtattcctaggtattttattctttttgtggcaattgtgaatgagagttcattcctgatttggctcttggcttgactgttgttggtgtgtaggaatgttactgatttttgtacattgattttgtatcctgagacttttttgaagttatcagcttaagaagcttttgggcttagactatggggttttctagatataggtcatgtcatctgcaaacagggatagtttaactgactgcctctcttcctattttgatgccctttatttctttctcttgactgattgtcatgtccaggacttccagtcctatgttgaatgggagtgctgagagagtgcatccttctcttgcgccggttttcaagggaaatgcttcaagcttttgcccatttagtatgatgttggctgtgagttgtcatagatgagtcttattattttgaggtatgttccttcaatacctattttattgagagtttttaacatgaaggggtgtagaattatattgaaagccttttctgaatctatgaaatagtcgtgtgattttgtctttagttctgtttatgtgatgaattacatttattgatttgtatatattgaaccaacttgtatccagggatgaaacctacttgatcgtggtggataagctttttgatgtgctgctggatttagtttgccagtattttgttgaggatttttgcatcactcttcatcaagaatcagggttcttgcactgattcttattatccttattatctttgtgggcttatgtaccttcagtctttgaggtttctgacctttggatggattttttcttttatcccatttgatgaccttgaatgttcgactgtggtgtaaggtgaagtgagactccagcctgggtgacaaagtgagactccatctcaaaaaaaaaagtcagctggctggctttgtttctgggggccaacactcagcactcaacacctggactgtatgttctaattctgggggacttgtattgggtcccatctttgttctctggctcctcgaggtttggaatccactgcactgtgcaggcagaggtacaacagctgtggtagagtgtttgtgggtgccagggtgcctacctccctgcgtgtgttcaccacagtggcggaggcaatgcagctggatgggggatgggggccccctgctggagactgtgtgtgtggtcacactggaggtggtggtgactcaggggtggggtgctggtgagtgcaggtctaggtgccttctctatgccccacaagcaggagtgatcactcatggtgggggaggatctgctgtcatatccccattctaatcaggagaaaaagataagacaaataccactggatggattttgtgctaaagagctgaccaatattcctcaaaagtgttaagatcatcaaaaacagggacagtctcaggaatttttacaactaagacaagactaaggaagcatgactagcaatggaaagaattaaacttttattctgcccttcctgtgtattttaagattactctacaggcacagttgaagagggagagctgttcctcactgaaaaatttaagccaagcctagtgaaggctatgtttaacaaaagaaacaatatctagaaccccagtgactgaactgatgtaggttgaatgaaacactttggttaaaggtcagtgaggaatcagtcaaaggaggaacgagactgtcatcacctgaacccacgatcagtgctgatatggtaaagagtgaaaaaaccagaactcatgtgcttcatgctgggatgctgtaggagacatggcaccactgatgaagtccttttatcagaagagtgagacctgcctctaaccttgtcacagaggctaacttcctatgatcagaaacactgggaaagagcaacaagttaaatgacacaagaaggcagcatacagacaaatgaatggtggtgagacatgctgcaggaccacaggccagtctgctaaaacaagccaatagaatgaaaaaggacaatgggatgaaggcagacattgtgggcaataggtctgctggagacttaaaagagacccaagagtatgatctaaagcagaacatccgtacaccctaagctccagaatgtcccctctgaggtatgtactagtgaaaaggcatacattcatttggcaaaagatgtgtctaagcatgccctcagtagcacgctagaaacagccccagtgttcatcaccctagcatgggtaaatacattgggatatatacaaaggaatactatacagccatgagcatgaaaaaaccattgttacttctacaacatggatgaaggtcactaatctatttttgatcaaatatagccagacccaaagaatatcagctcaataattccatttaaataaagatcaaaacaggcagtactactctatccactaaagttaggatagtggttaccttgggagacagtgactgggaggggaatgagggggattctcagagaatatgttaatttcttgagagacgatgggccctccagggatattcacatatgaaaattaagcaagtctatgtttgtgatctgtgcacttcgtcagcagggagagggagaattaggagacatgaatgaatacagtgtgcgaatctagtgggtttggatccaaacagacacaatcccataggccacaattccaaatgttgaaaccccaaaaggtcaatctttctaaagtctaaattccaaaatatcaaaatccctaagcagaagatgagaaaggttaatagagaatgctcatgtcagtgtaacatagaatttcaataaagcagtgccatgaagaaaacgaatgtgaatatattcactgaggatacccatgtcctaaaagagaaaaaaaaaagcagctatatgatgcgatgcatgacttcaaaatatagtaaatgatcgtgaaatctggccagttcttaaccactatctccatgcaattgcccgtaatttatacctgtgatgcactttttcttatgtcattttttaaagtttttgtttcctatttcttttctttttttcactatgttaaattgtcagcattattttttacaatgtgtcatatttctttcatcttggcattgcttccagtactagaggcataaattgtgtagagacttttaaagagtctaatttgttttatgcattttttcaaattagattccacaaaagtacattatcacaatgctttgtgtgtaagcattgtgacgcatgtataatcttgctgaataaatgaagagatgtctttttttgttcatgtgcatttttgaaagataaaatttctcgagatcttgactctaggtgaaggtgtgtgcagtggtgatccataatggtttttgattgtagttgtaaaagacttaggttgttggtcacagtatttcatatgacaccaaacttataaaatgagtttacaaaattatcaactatagtaatatttgttgatacatttccttgtgtgacctatttctttatgattatggtttgtccgcttataagagttatacctgtgtgactgtcattggtgtaactgtttgtgcttgcaaatatatgcatgttattgttgtctatttcattatataaagtggcttatgaagtattctatcatgtttttacatttctcaaataagcctacatttttaaaggtaaataaacatcttcaatgatttttaaaattatttttcccagaagtgcatttttggcattttgatattttgggatttcagcatttagggttatggtgattggcattgcatcttgtgggattatggtggactcctcactgtaggcattgtattctggcctgctggccctagtgtgtggccaatggtcagcctgcccagtggggttggcctacaggtgacctttgggtcacccagtcagctaggaatgaaggagatgattcagggcaggtatatgggagtgtagggcccacccttgaacaggagtgcagcctctggagggtggaagggacctgcaccatccatgtacaagtggaagcttctccatcctcacccactctgtcctaaaccccaactctcctccagggcccttgtctgtattttagaaaaggtggtgtcctaatggagatggggagaagacaggtgggccaggtccagtgacagtctctcactggcttccttgcaggcctcagccatgtggcatggggcatctggcactgggtaactgttgattacagcaacccttccctggtcatggggtagacagctgaggccagggtgagggcagagccctgttaaatgcaactgttgctggttataagctgagccaatcacgtaccttctctgcctcaattcttcatctgtaaagtgggaacatgatagtacaagttcagagaactggtgtgagtctttacctgatgtcacccacctgcatgtaaaatgactggcccaaatgatgtggtcagtaagaagtagcttttgttacagtatgtctaaaatatgccttccctcatattttaacatttctaaacctgtatatgtcttcagatccacttgtacactgattagtgcatttattttcatttcctcctgaaaatctgttatgatggatggttcatctcacatctcggaactgtgaagacatggtataacttgttccaggtctggctgggtaacagtcagggctactggaccagggcctggattcctacatgagtctgtgggacttggccctgggaaggtttccaacacatcttccaggaccacactccctgcacccaaccccagacctcaaagttttgcaagggacagtcctccagctggaaaccctgaatgcccacactgtgcctgtccctggactcccaggttcatgtttctagagaatgctggagccacattccaaattcttcctgccatagcttggatttgcaaggagccttccacatagatatgtaaaaaccatttttgctcacacaattgttttcaaggtttgactcagcctagagctacctacttagaagctgcaagcctctcttgagtccaagatatttacaatttcctcttctgaatttccttccagaaagcagccagaggaggaattatgtccccaggacacaattatgtgctaaaccatggctaggaacttgttgattgcgtagacatcaacctttcgtatgtccaaggccttgccctctcagctttgtcatccactgcacttttcttttttgcacactcaggaatctgccacaccacctgcccttcacccaccttctgtcagcattcaatgggtgacaggaaactgctgcacaaagtgctctgggggtctgtgtcatttgctatgtgcaaccctcccttcaatgggtatttggaaggagcccatctctccgatgagccagactagaccatggaagggttcagacatggcccaggttccacagtgaagaagtaagaggaccagaataggctcacataatcagaccctcagactcacaacctctctcaagtagaatgagtgttctattgaacagaggagaggaagttgtctttgtagccagaaaagtactgaagagagtggaaacagaaaacaaaaagcaggttggtcatttcaaagttgctttccatttaggactaaagtggaagagacttcctgattatgctgactcatgttgattggaattttctttttttttaaatatatatatattttttattatactttaagttctagggtacatgtgcataatgtgcatgtttgttacatatgtatacatgcgcgatgttggtgtgctgcacccattaactcgtcatttacattaggtatatcttctaatgctatccctcccccctccccccaccccacaacaactggattaagaaaatgtggcacatatacaccaaggaatactatgcagccataaaaaatgatgagttcatgtcctttgtagagacatggatgaagctggaaaccatcattctcagcaaactatcgcaaggacaaaaaaccaaacaccgcgtgttctcactcataggtgggaattgaacaatgagaacacatggacacaggaagggggacatcacacaccgggattggaattttccgaattatttttaactggcccatttgaaagttcaatttgatttcatgacaattagcatgaatgactccattccgatttgttcttctggggcctagtaaaggaggctggtctgacacaatggcctcccattaactttgtttcacaatccccccattttggccagggtgagagtgtggccaaatcagagggcatgagtgctacactcagttaccatcagttttggatttttggtgttaacatgccatttgtatattacagtgtccttgttgtcatgtgtttcttggagctttcatcattccagctggagagaggccatttagccttcagcagatggctgcatggagatttctaagccttttcgagaggatgcagtgaactagggagaccactcttatgactgtcaggaggataatgccaagagtttggagtatgctcttgcaatgggaatgacagagcaaaggttgctgcctagccaattgaagtagaacatcacacccaaatgtctcaagcctctggtcagagataaaaatttagaggtgtctctcccacctaaaagactgggcttcccctgtttttccctccatatcttttactttaaaagtaccattcaggcatttgcctgtgaacttaacatgacccatgtcctatttttctatatttatactgctctctctctctctctctctctctctctctctctgtctctgtctctctcccttccctctctctgtgcctgattctttgcttcttcattcctgcctcatatcattagggaatagagaaccgtcctcccaactctttgaaccctctctgaccaggatctgtaagtaataaatctttgaacttatttcctgtcatggtggtaatttgaatttttgccttccatttgaatatcctgtgtctaaccaaggccaggctttacctgggatgttgtggggaacacaagatcagggtccatgtgacagaacggtggtcaggcaggcataaacgaaacacagattagacaagaaccacagtgacatctgccattataaacaaatttcccacatgaggggctacctaatcaatggttggacaactaggcacaagaattatcctgtgaaaggcatactggaaacacctaccttaagctccccttcatttccagttatggaaaccttaccagctactctggtactggaacctcagtttggctgggaattttaaaaacagccccttaggcaggcttcccatgaattaaaccaactgaaattgaacagatcaaagaatgagccagatgaggaatctacttgttttaaccaagcagcctgtttgtcctatttatccacatgcaactgaaagtgttagcaactgcagagatccctccgttttgagctagaaggttgcagttctatgatctactatcctatcacagggctaaattaaagcagagagtgaggtcaagtgggtctggaagtctgactctataaaagggattactagtaaagtttggataaacaattgcatcaaggatgttgataaagctagctactgggtggattaaaaattctcttaggtcatgtaaaaatatgggtttggcatggcatatccaactttttatggaatctaatcattgtaaaattctaactacttttgacccttgaacaacgtaggtttgaaatgtgtcggtccagttatacatgaactttcttctgctcatgccattcctgagactgtgagaataaccactcctcttccttctcttccacagcctactgaaagtgtggatgatgaggacaaaaacccttatcatgacccacttcacttaataaatagtaaatatattttactaaaatatacaaatacgtaaaatatataaatgcaaaacccttatgatgatccactttcacttaatgaatagtaaatatgttttgtcttacataggattttcttaataaccctttctcttctctagctttctttattgtaagagtatagtacataatgcattaaacagaaaaaaatatgtgttaattcttacggtttccagtcagccgtaagctattagtagttatgtttctggggagtagtatgttatatgtagatttttgactgcattgggagtcagtgcctccagccctcactttattcaagaatcagttgtacaggtattatcctgacaagtgaatgaggtaagcataagtaagaaaaaattaagaggggtaagggtgtcattgtgatagtcttatttcaataagacttcagtaagtcaataagttttatttcaagtgtgacttcataagaagtcatacctttttaacttttatgttaggttcaggggtacttgtgcaggtttgttatacaggtacattgtgtgtcatgggggtttggtgcacgcctcatccaggtaataagcatagtacatgatagatggtttttcaatcctcaccctcctcccaccctccaacttcaaataggctcttgtgtctgtgttcccttctttgtgtccatgtggactccatgattacctcccacttataactgagaacatgtggtatttggttttctgttcctgtgttagttcacttagaataatggcctccagctccatccatggtgctgcaaaggacatgatctctttttatggctgtgtagtattccatggtgtatatgtaccacattttctttttccaatctattgctgatggacatgtaggtgatcctatatctttgcttttgtgaatagtgctgcaatgaatatatgcatgcatgtgtctttatgatagaacgattcctttgggtatatacccaataatgggattgctgggtttaatggtaattctgccttaagttctttcagaaatcacaactgggtttttcacagtggcagaactaacatacattctcaccagcagtgtataagaattccctttcctctgcaacctcaccagtgtctgttattttcttcactttttagtagtagccattctgactggtttgagatcgtatctcattgtggttttgatttgtatttctctaatagttggtgatgtggaaaattttttcatatgtttgttggccacgtgtatgtcttcttttgaaaagtgtctgttcatgtcctttgctcactttttttttggggggtggggtcggggaacagagtctcactctgtcgccttggctggagtgcagtggcgcaatctcggctcactgcaacctccacctcccaggttcaagcaattctcctgtctcagcctcccaagtagctgggattacaagcatacaccaccacgcctggctaattttttttgtgtttttagtagaagcagggtttcaccatattggccaggctggtctcgaactcctgaccttgtgatttgcctgcctcagcctcccaaagtgctggaattacatgcatgagccaccgtgcctggcctctgctcatgttttaattgagttgttgttttgcttgtaaatttgtttaagttccttatagattctgaatattagacctttgtgaaatgcatagtttgcaaatattttatcccattctgtagattgtctgtttattctcttaatagtttcttttgctgtgcagatgctcttcagtttaattaggtcctatttgtcaatttttgtttgtgttgcaattgcttttggcatcattgtgaaatccttgccagggcctaggtctaaaatggtattttcttggttctcttccagggtttttatagttttaggttttaggtttaagtttctaatccatcttgagttgttttttgaatatgatgtaatgaagtggtccagtttcaatcttctacatatggctagccagtaatcccagcaccatttgttgaatgggtagtcctttcccccctgcttatttttgttgactttgtcaaagatcaggtgattgtaggtgtgtggttttatttatgggttctctaacctgttccattggtttatatgtctgttttttgtaccagtaccatggtttcttggttattgtagccttgtagtgcagtttgaattcaggcagtgtgacgcttcaaactttgctctttttgcttcagattgccctggctatttgggctgtttttggttccatatgaattttaaaaatagattttttttctaattgtgagagaaatgtcattggcagtttgataggaatagcattgagtctctaaattactttgggcagtatggtcatttcaacaatattgattcttactctccttgaacgtggaatattttccatttgtttgtgttatctctcatttctttgaccaatgttttataattcttgtagaaatgtttcatcactctggttagctgtattcctagatatttcattctttttttgtggctgttgtgaatgagattgcattcttgatttggctctcttcttggatgttgttggtgtatagagatgttactgattatcgtacgttgtgtatcctgagacattgtagaagttgtttatcagaactagaagtttttgggcagagactatgggttttctagttatagaatcaaattgtctacaaacagaggtagtttgattttctctcttcctattttgatgccttttatatgatcctcttgcttgatttctctggctaggacttccattactatgctgaatacgagtggtgagagtggtcatccttgtctttttctatttctcatggaaaatgcttccagcttttgcccattcagtatgatgttggctgcaagctcgtcacagattgctgtcattatttggaagtatattccttcaaagcctggttttttttgggtttttaacaagaaggaatgttgaattttatagaaactcttttcttcatctattgagatcatcatgtggtttttgttttagattctgtttacgtaatgaatcacacttacttacttgcatatgtagaaccacctttacatcccggggataaagcctacttgatcatggtggattaggtttttgatatgcagctgcatttggtttggtcctatttagttgatgatttttgtctgtgtcaaggatattggcctgaagttttatttttttttcttgtgtctctgtcaggttttggtatgaggatgatgttgacctcatagaatgagttaaagagagtccctcgtcctcaactttgtggaatagtttcagtaggtatggtaacatcacttctttataatctggtagtatttgactgtgactttgtctggtcctgagctttttctagctggtaggctttttactacggattcaattttagaaactattattggtttgttcaggcattcagtttcttcctgttcaatcttggaaggttgtatgttttcagaaatttatccatttcttctaggttttctagtttgtgtgcaaagaggtgctcatagtagtctctgagactttttttttgtatttctgtggggtcagtggtaatgtcccctttgtcttttctgattgtgttcatttggatcttctctctttttttgttagtctggctagtgttctatcaatcttatttatttatcctctcaaaaatcaagtcctggatttgatttttttaatggcttttcacatctcaatttccttcagttcagatctgattttggttatttttgctcttctgctatctatggggttggtttgctattgtttctctagttcctctaggtttgacattaggttgctaatctgagaactttccaaccttttgatgcaatactataaacttccctcttaacactgctttagctgtgttccagagatttaggtatgctgtatctttgttctcattagtttcaaagaatatttcaatttctaagttaattttattatttacctaaaagtcattcaggagaagcttgtttaattttaatgtaattgtgtagttttaagcgattttctttgaattatctttttatttcactgtggtctgagagtgtggttggttggcatgttttcttttctttttttttaaacttgctaaggattgttttatgtctgattgtgtggcttattttagaatatgtgccacgtgcagatgagaataatgtgtattctgttgttttttgttggagagctctgtagatgtctgctgggtccattttgtcaagtgtcaagttcaggtcctgaatacctttctctgttttctgcctcagtgatctgtaatactctcagtggattgttgaattttccagctagtattgtgtggttatgtcagtctcttcatttatctctaagtactttctttatgaaactgggtgcatatatatttgggatagttaagtcctcttgttgaattgaaccctttaccactttataatgcccttcattgtctttttttcatctttgttggcttaaagtctgttttgtctgaaattagaatagccacttctgctttttttctgtttttcatttgttttataggttcttctccatctctttactttgaccctatgggtgtcattgtatgtgagatgggtctcttgaagacagcataccattggatcttgcttgtttatcttgcttgtttagctagtttgtggattttaattgggggaatttagcacatttgtattcaaggtaacaattgatatgtgtggaattgttcctgtcatcatgttgttagctggttattaagtagacttgtttgtgtggttgttttatagtgtcactggtctatgtatttaagtgtgttttagcaatggccagtaatggtctttcctttccatgtttagcatttgcttcaggacctcttgtaaggcagccctggtggtaacaatatcccttaacacttgcttgtctgaaaaggaatttatttctcttttgcttatgaagcttagtttggctggatataaaatttctggttgaaaattattttctttaagaatgttcaatgtaggcctccattctcttctgacttgtgcagtttctgctagaagaccctcagttattctgttggggctccctttgtaggtgacctgccacttttctctagctgcctttaacatttttttgtttcatttctaccttggggaatctgatgactatgtgtcttggggatagtgctcatgtgtagtatttcacatgggttctctgcatttcttgaatttgaatctcggcctctctagcaaagttggggaaattttcatggatgatatcctaaatatgttttccaagttgcttgctttctctctctgtctttcagggacaacaatgagtcatagaattggtctctttacataatctcatatttctcagaaattttattcattcttctttattgtctaagttgttttggaaatcaggtcttccatctcttagaatctttcctcagcttgatcaatttaattgttaatacttgtaattgtattttgagattcttgaagtgaatttttcagctttatcagcttggtttggttctttattaaaatggccatttcatctttcatctcctgaattgttttattgcatttcttagaatccttggattgagttttgctcttgaaggttgatgattttcattcctaaccatattctgcattctatgtctgtcatttcagcaatttcagcctggttaggaactattgctggggacctagtgtagctctgactttttgagtttccagagttcttgcactgtttctttcttatctgtgtgggctggtgttcctttagtctttgaagttactgtacttcggatttttttttttttgcatttatcttcttttttgctcttaagggtttgattgtggtatcaagtgtgtgcagtcaactggcttcatttctggatgattttaggaggccaaggcttagctcagcacccatgaattgtgggctctaactgtggggggctgagactgggcccctagctttgttctccagctgctcaaggttagcaacctgccatgctggaggagaagaggtgttgctggtctgctggtcaccacactcccatgagtggtgctggctgaagtacattgttagggaagtgacattgggatccttgcctccttacacatgttagcagccacagaaacacagcatggtacatgcaccatggctgaggctgagtactagcaggaacaaggctgaggcattatagtgtatactcatggcagtggcagcagctgtggtatgacaaggtatgggatgtcgacaggggcagggttgctggagtccatgtgtccactcatgccaatgttggcaacagcaggggtgggacacaggcgggcctggagctgctggcttccatgagtgtgtttgcaccagtagaggtggcagtgcaaggtggtggggcagagctgctggtgtccatgcctatgttcacacctgtggcggcacgggggaggggggctggtgttgccagcatacgtttgcacattcacgccagaagtggcaagatatctaggtgccaacacgtcagcaggtggtgtggtgggatgtcctcacgccagcagcagtggcatgacatcctgtttgctcatatgcatatcagctgaggaggggagttgaggtctgcctgcatgtgtgcataagcaaagtggtatggtggtggctgtgggtgagtatatgccagcaaagtggtgtgggggaggctgcagtggggagagtgtacaggtgggctgggacactttgatgggggccactctgctgcagttatcaaacatgttctgctggtgaaggaactacgataaagaccccgggaagcactgtggtagggcatcccaggctgtactgcaagcaggcaaggctaggctggggccctgggagatgagagcagacagggtggcactcagattggacaggtcccatgtcacaggcaatatcatgctggtctgtccaggtccgacagtcgccccaaggctaaagtcttctagaggaaaatggtgagccttgtggaatgggcatccctggtggttctccactgcagatatttcagcaccaaaccatctgggctctgcacaggctggagtattgaccctaccacctctctaagtagctctccctgccagctcaagtgcctgtgggggttgtggggtctcctgctgctaggattcctcatgtctatggcaagagcagaccactccctgcctgtttaactcaccccttccccagttgtcgctggttgccaggaatgagtcccggtgcatggtagccttgtgcagggttcccagcttcctcccccttcagcccagcatctgcatcccatctccatccactctcagtgctttccctctgaagatctgcttggagtgtgacagtcttccatatgtcctagtctctcagtggcagatgatcctcctggctgtgtctagttaaccatcatgactgaaactctgaagtcatcaacttcttaccctggtttgcagtttgaatgtccctggttatggcttcacggattgtagtgaactcctgattggctcacatatcaggcaggaatgttgtcccttgacacttacattgaggggttcacctccagcctatagaggaatggagcagattttgttgttagtacaggaattgtagccaggtaatggagaaaactagaacaatttggaatcaagtatggtctacaaatagataataataactcaaaaacaatgaacagagatacagtctaataataggtgcacaatagttttttttttaaattttcccaaaacatattttttctgtcttcggtcatccccgtttctaagaaagataatcagagtatgactattttgatagcaaaataagtttagtatcatcaaacttggcctgattatttacttaagcgcagtaaagattgtgattagccaaataagctctttttaaaggttgctctgctggagcttttaataaggattctcagattacacttttcaaagcctcttcatgctaggaagccaaaccaaggcagacttcagactgcctgctatacagatttgggtgaattcctctcttctccgggtccccaaaatattttgaggtccctgggccttcaggaagtgacttttttttctcactcagtataaggctaggaaccctcaaagccatgaattctatggactttcccaaatgtggtgtcccagtgactgtcttggtaatataactagtattgccaactgtatcctgttataaagagagcagattgtgattgaacttatgcaaacaatatcgccataaaaactagaaaatatatatattgtttctgattcctagagggaccaagtagacagaaaaattaaatgatttcaattttgttcacaaaattatactttaccaaattatagtgagccctagataccttaaaataaagaagtttccttaaatctggaaaacaaaacattaaaataaagaagcaagaaaattccaaaataaaaaatatgaaaacattatcctcatcagttcatttattcccgtgtaattaattcttgttctgcttgatgttggagcaatggtttcatgaagtcatcagtttcttcattagatttatggacattcttatcaagtccaatggtatgatcttaaagttaccagaatcctgtacttttcagaatcttttccatgagtctttttgaagacaaagcacttaaggattacagttgctgggccaggcgtggtggctcatgcctgtaatcccagcactttgggaggccgaggcgggtggatcacctgaggtcaggagttcgagaccagcctggccgaaatggtgaaaccctgtctctactaaaaatacaacaattagctgggcgtggtggcaggctcctgtattctcagcttttcaggaggctgaggcaggaaaatcacttgaacctgggaggtggaggttgcagtgagctgagatcacgacactgcactccagcctgggcgacagaatgagactcgatctcaaaaaaaaaaaaaaaaaagaggaaaaaaaataggattacagttgcttgaaaaagcattcaaaaataattaactgtgggtgacaagactcgaaatggtcatggtttaaaatctgatgagctcattctcagcaaactatcacaaggacagaaaaccaaacaccacatgttctcattcttaggtggaaatttgacaatgagaacacttggacacagggtggggaacatcacacactggggcctgttcgggggtcgggggctgggggagggatagcattaggagaaatacctaatgtaaatgactagttgatgggtgcagcaaaccaacatgacacatgtatacctatgtaacaaacctgcatgttgtgcacgtgtaccctagaacttaaagtgtaataataataataaaaatctgatgagagtgcattataatgatgacactgttgataaggaaatttggttatttctgtgacatacaacattttaacataatggctgaaatgatgactgataacgtatcagttttctaggaatctcatgcaacttttggagtgcatattagtgacatctataaaaatagagtcaaagtaggttaaatatcactttttatttgacaatgtgtcccaataatttaacttatcaaataagcctaattggtttaatatctcccttcctttgaagaggtttaggagccctttggaatgttctaacattaatttaggatcaagaaagacttaatttaggatatgattttgagaagtttttgaaagatgtcacaaggtttaaagcacttcactaaacagtatcaccaatcattatgaaacaaagacaaatacagatatgttacatagctttcaaaagacttaggtctctgaagatttataagactaattttttttaaaaaaatcaaaatacctgataaaagacccataaaaagacaaaataccttataaaagacgacaaaaaaatcctgacaaaacactgaatttattatttttttgttccttaggtagatcactgaaaggatatgaaaatgtttcctagtctcttatcaacactccaaggaaatacccattttcaaaagcaaagacccgattctagttttgcatcagggtacttttgatattaaagctcattcaaaaaaacctcttataataaatttattccgttttagcatgcttgaccccacatgaaattcttttcacaatcctattatgttcttgtatctctttggtctttcatatactttttcacattgtggaacaatcagtcattctattttagggtaaaaattgttctctttttcccttaaggcaaacacagcatcatacatatgcctttttttaaaataagatatgccttcctttcctcacttatagagttgttttcctttattttagttttagttaccacatgttagaattttcaaaatcccttatgatcttaatttttatgtgaaactatacaggaggcaattttgaactgtcatatgctaacattttatagatatacttttcatatcacaatttttttgtttaacaacagactcaaatatattaaacttcactatacctataaaaataagcttccaaagtatcgatactttatatttatgttcagcaattaatgtttcaataatttaacttgcttaggaatgacttagacattttatgactatctattatttcatttaacataacataatattaagatgcccagtgatgaaacaagatttttttttcaagttttattttactttcaggggtacatgtgcaggtttgttatataggtaaacttgtgtcatgggggcttgttttacagattatttcatcatccaggtattaaacctagtaccattagttatttttcctgatcctctccttcctcccaccctctaccctccaataggccctagtatgtgttgttaccctcttatgtggccatgtggaaaaatatttttgaaactatggaaagcttacttataaagtttattccatttatatttacctaatttactcattcttaacaattcaattgctcattaagcaaagctagctattggaggagttcataaaatgccaacctacaatgcgttgctttggtatactaatcactttgagcttaaggctgttgaagaatagcaaaatgtaaggcaaggctctctgaattccccttatctatctaaagacagatccttcaaaaggaactcaactgtcatgagtcctctgaagatgactcttatcacataataggaggtcagaagtcgacattacacccagacagacctcctcacaaaccaccatctgttcttctaagagaccattaatcttccctccacatcagttactctgaggatgtctcttcttcatcccctgaccattttacccactccagtgagggggttgaatcaagggacccttgccctattcttgatccacctacctgattgttgccctgagcaattcttacctgagcacttcttaccttgtcatctctgccttgtggtttttaaaatttttacagaaagggagaaacagagcacacttgtttggggtactgcaaagttggggaactagcagagagtttctctggtccattcaactattactagatttaaccttttttctaactgcattactgtcgttttaattcatccaatttttaagaaagaaaaattatcctaaatttgcatctcaaaagggatagttcttaggtaaatcaaagtaggaaacttacatgtcaaaggcacaggacttagatttcaggactgagttcctttacttgccagactgaaaaggaacagttaggaagtccagtaaagacaaaatggtaaaaggtgaggcttgtctaaagcaatactttctcccactgcaagaatttctggtgattttctaaatgccagaaagtcgtattttggagactgatttagttcgatgtgtggtattttcaactcagcttctgtttctcaactaaatgaccgagtttaaggcaatgttcattaaggaatagtgcaggcaaagcattttctatagctggaatcatcagcatggatagttctgaaaaagaaccaagcctgcttgtcctcgacttaacttataaacgccttatctagcttcctttctatctttggagcaggaaagtaactaagtgaaaatgttggcagattccattttcctgttaattacctacttaaactttgcatttgttttctataagggatttcttaaagaggcaaggcttaaaaaaatctttttagaagtttgtgcacatgaatagtcatccgtgtgggggcctatttcaggaggcctaactttcttttgacaggtaatttggatctttatttcagtaattgtccacatattgtggtaaacactcttgtttttaacaagatcgatatctgcagaaacattgtttgacactttgttagaagcaaagtgtctttttctaatatgatggatacatattattccattgaaatcaacaattgagagtcaagtttgataattgaaagaccttgttgattctaatagaatctaaaataactgcttttttctaatgatcagtgatcttgagctttttttgttcatatgattgttggccgcatgcatgtcttcttttgaaagtgtctgttcatgttctttgcccactttttaacgggattgtttgtttttttcttgtaaatttgtttaagttccttatagatgctggatattagacctttgtcagatacacagtttgcaaaaatgttctcccattgtataggttttctgtttactctgttgatagtttcttttgctgtgtagaagctctttagtctaattagattttgtcaatttttgcttttgttgcaattgcttttggcaacttcatcatgaaatctttgtccatgcctatgtcctgaatggtattgcctaggttgtcttccagggtttttagttctggattttatgagatatcatctaatagcagtcagaatggctattaataaaaagtcacaaaacaacagatgctggtgaggtggcagagaaagagaaacacttatacactgctggtaggactgtaaattagttcagccattgtggaagatagtgtggcaattcgtcagagacctaaagacaaaactaccattttacccagcaatcccattactgggtatttacccaaaggaatataaatcagtctactataaagacacatgcatgtgtatgatcattacagcagtattcacaatggcaaaaatatggaatcaacctaaatatccatcagtgagactggataaagaaaatacaccatggaatactatgcagccataaacaagaatgggaccatgtcctttgcagggacatggatggagctggaggaggaggcctaatttttaagcacatttttggggtgaacaaccttgttcatctgaaatgttcacatgatggccattgtaagtctaaattatccttattaagattgtgccattttttaaagagcttgcagattctgctgcctaatacttatacacataaaaagcaaatatagccagaaggtggaggacacaggtctctggaaagtaaagatctcagtaaaaattgttttttccataggttattggggtgcaggtggtgtttggttacatgagtaagttctttagtggtgatttgtgggattttggtgcacccacctgagcagcatacactgcaccacgtttgtagtcttttttccttcaccccctcccacccttcccctacaagtccccaaagtccattgcatcattcttatgcctttgagtcctcatagcttagctcccacatatcagtgagaacatacgatgtttggttttccattcctgagttacttcacttagaatgatagtctccaatctcatcccagttgctgtgaatgctgttaatgcattcctttttatggctgagtagtattccatcatatatctatctatctatctatctatctatctatctatcatctatatatctatatatatctcatatatatcagatatatatgagatatatatatatatatctcatagtttctttatccactcgttgattgatgggcatttgggttggttcaacgactttgtaattgcgaattgtgctgctacaaacatgcgtatctaagtatcttttttgtataatgccttcttttcctctgggtagatacccagtagtgggattgctaaatcaaatggtagttctacttttagttctttaaggaatctccacactgtttttcaaagtggttttactggtttacattcccaccagcagtgtagaagtgttccctgatcaccgcatccacggcaacatctactgtttttcgattttttgattatggccattcttgcaggagtaaggtggtatcaccttgtggttttgatttgcataaggacatgaatagatgattctcaaaagaagatacacaaatggccaaggtctcatttttatgttgactcttgggtctttcagagctgacatcaaagtctaagaaggaaatgccttgggattgggtcctggattgctttctagtgaaccttcccgcatggatgctgtcttgaagttggtgggtgacatggtattaaacttgtttcatgaccagctgatcctaacatggatgtcttatttacaggtggtgagtgctctaatcgctcctaagtgcctaaaccatgcccaccagtcagatcatggctgtgactctgaggtccccttgactaatgtagccaatgaatctctcatactatgcacacacaccaaaaggaactggaagaaccaaatctctgcaaatttccaaaagccagagtcacacactgcatgtggtaagcttctcccaccatcagttacctttaaaactgcaagtcttgtcagtgacttgtcagccccacaaacccccaagaaactcatgtgctctctcaccggacacatgaatcctggaatcaagagccaaaagtatcaggggaatcaatacaaaaatgtgaccctagaggaacttataacccttgtgtctgtgagagtgaaaggggactcaaaagctgtcagcggcatctcccctgcatttgtcaaggggtctccagagtcatcagcagtgccttttgggtcctatcatgggttgccagaaactgctaaaagaacaaataacagcaaatcaatttaaaaatcaaactggcttttatttgcaatactagaattgggcaacagcacattctataaaatagaatgagtgtgccaatcaaccgagaggaggaggttggctttgaaggcagaaaagggctgaaagaagcagaaacagaaaaaaaaagaaagcaggttagtcattttgaatttatgttccatttagggttaaagaagatattccgctgactcagggactcaggttaatgggaagattctgtttttttgttttgttttgttttttgtttttccccattggaaagttcaggatcattacttaacactcagcacaagtgaccccattctggttgggtgtggtcagctggggcttaggacaggaggctagttcacagcagtggcctcttgtgtaggttgtttcactcaagcccctgagttaatggagctttctaaaggaggctgtgctagctttcctaaacagccagctttcctccccctctgtagacaggaacatctggatgctagtggtttacactggttttcttttctacaatatcttaaatgattttcatagaaaagcttgtctgtgaggaattgtagtattaaaattctcaatcgatatttagtgcttggatttgccttctctctctctctctctctctgtatgtgtgtgtgtgtgtgtgtgctaagcttttcaagtatggaaactagaacatgtctctgtaggtgataattcttgcctcttggggtccctggagaaaggaagtccacatggaaaagagaagcaatcttcaggtggagatacatcctcagagatttaaaagcagttttcagcctgtgttatatacacgtaccaaagatgacctgtgtgtaatccctaggctggatgaatgccttggttgtcgtttagacatgggatgttgctgttgattggccttgaggctcctcggctatcctgcagtaccgctggtgtttctctactctttttcttcacaagactgagacctgttggctccgaagcccaccagcacaaaactcaatttttcacacgtttgatcgtttgaaacatggcactgccaagcagattgttaggcattcagagcctacctggcttccataccctgctaaacttcaccccacatctgctaaccatagataagatagaaccttgtggttaggagacctcaaagccactttgtccagctactgatacacagcagctagacctgtaaggcccttatccaattcccacctcctccagcagttctcctgccttcttacatgtctgatggtgacccctgaactataaactctggacagccctctgctctgaggatatcccctccccagcaccctatccaatcaccacccaataaagctgctttgtgtggtacagcctctggtggtcctatcattttccttgatcaacccccccaggcgcacacagtgtgaaatgagctcttatgaactcagatatctgacccttagaggctgatgattgagctgagttgcatgatttgagggggtctgtttggacaaggccaaaaggccttaggaaagcacaccaggcaggcatctcacggggacatggaatgctgatgttgtctggccttgcagcatctcggctttcttgtgctggagaaacccccctgactgttttggattctgaattcacagatctcaacaggctgggcttgactctaagttaaaacccaaattgtccaccctgagctgtttcagactcgccacaagctgtgctggatagaaagcaggcgtagctcaatgcaataaattagtctttgacactggaatcttgattgttctgggccctactccatggggttcaaaactgttgcaacctgcatgcagccctgggccatccacatctcttgcagatgcccatgatttagggcttgttctcaggtgggacccactagagtgggactgctcatgggcactgtatttctgattcaggcggattgcacttctaaccagtcatggtggccaaaagctgcacatcgggagagggcaccccacagagactgtgatccctctgcccactcatgacggatcagtctcgaaccccttctctgggatgcccactgctggtgactcgtgtttgacaacctacatcagttacaggttggtatagcagatggacagcctgacttcacttcctctctctcctcctggtccacatgccaggcaatggggtcatcaaatgcagcgatgcccaggaagggatgagttttttctgctctgctcactgcataaataggggggatggaaagggatatgtaaacccattttgaaatcttttcaaaatgcaggattttaaatatgatgggtttttctgtccacatcttgttttatgacagtgtttttgtccctgttacatacagccttgctaggtgagaaggcctgagagaaggtatgagtgattgagggaatgtaaagtttttattactgagtgagccacgttgattttataagggtggagaaaaacacaagatatctgtggaggtgagagggagagcactgtggtcttagtgttgcagaactgttcctggaaggtttcttcccttgctgaaggaaaactccccatgctgcctttgcaagctgctgcaagctctgtgactccaaactgacagcttcacctgagcccatacctgacgccatacctgaccccactgactaggggagagaggcggtggctccagcccctccatgttccccacggagcacctgcagttgtcatccacagtagtcatggacaagccaaattgtctgcaatgaaaccagggactgaactggattatgtggcctgtactggataccccgtggctggcagcagctgccacagaggaaggccacaatgaggccttgatgtcctgtgcttcctgacttaggtacactctcttggggtgcccaaaccatggtacacttggtgtgtgcagggacaccatgtgtgccctcatgtattgtacatcctgtgtgccctgcctgtcatgacactgcctcaggcctggatgactttcagatcagctccaacttactgaccagagttgtattctacctgaattgatgccctcggctaggtaaaaggaaaccatttgtactaaaatttaaggagggagccatttggttgtctaagatagtcctgtgtggttaatggggtttgtgttgactggttcaatccaggactcctaacaggcataagtgatatctgtatgcagcttgattacaccctgctgtgtccggtcctattgataatttcctgtaatatgccttgaccaatggggtgcactgtgcagaaaagactgcacacagcaggcttcattcctctacttagaacagcctattactttcaacgttgtccattggctggattctgaggacttggatttgggagggatttcacttttctcagaactcattatacctaaactatgtatggaaacaaaaagctgcacagtgctttcctcctgggagtctggaattttggtccatgcctgggaagaaccacttgtgtgaccagcccaagttcaactcatgggtgatgaggttttactgaactccactggttggcagcattttacatgtgtggtcacaccttgttgtgagggaattaagtgcattctgtgtgaccctactgggagatgagatgactctggaaacctgtgtctggtctcctgcacttctccctgtgcaccctttccctttgctgattgtgcttggtaccctttcactgtaataagttgtagtcatgggtaggactatatggtgagtcctgtgagttccccgttagtgagatactggaccagatttagtggtttggggtcccccatttggtccatatgccccatatctggcatatccatccagcccctccatctcacactccaggaagttcagatcaggacactactgagaggaatcataatggacaagcttgcttgagtgtttcttagatctcagggactcttctcaatgctttttaaaacatctaatatattcctcatcactcaccgttgagatagattctatcttttcaccaattttgtgaaataaatccttggttttctctatgcaacttttctgtaaatccaaatctcttctcataccaaaagttcatgcttctataaagtaaatggtaccaggaggtttgggcaaagaaactagaagttgaagtaaaatcagtatggtggtaaaatttttgtgcttttttttcctcctctatctccaagactgaactcaaaggctgcccaaatttctaaattgcacatgaggtgtggacaaaaagagttttatgaaacaggtctctgtctatggcccaagagctaggaaggcaggcccatacagtatacagggaatgagggaaagaacatttggatcctgctggcccagctcacagattagctccagtcctgaatctgtatcctgtggctgcagcatcaaccacagctggaaaagcatctaaaaatctcaaggaggggaatcctactctcaaacaagagattttgtccaaaaaagtgtgagaagattggaaggtggtaatgagtagcacttttgcaggtctcagcccagggcacaggccaataaaaagactgagacttactcataggtctgtggaacacttcctctttgccacaccttaccagtatgtcagtaggactcctgtgtaatagcaggggaatagcactgaaacaacttcatatctcagatttcatttaagaataaatatctagggaaactcaacacaagagcagaaagtttaacctctgaaacctatggctccaggaaaccgtaaacacagttgcactcctaaacagacaaaaataaactgtaactataaaggcttattttcctcaattccatttacctagtacgttatgtctggctttcaactgaaaaaggagttacaaagcattataaaaaaagaaaatacccagtttgaagagactaaatatcaaacagactcaggtacggaagagatgttggattatcagtctgacaatttaataccagtatggtgaatatgctaagggctctaatggaaaaagtgaatagcatgcaaaaataggttggtaatataggcagagagatgtaaactctttgaagcagagtcaaaaaggatatgctagaagttgaaaatactataaaaccatcagtaaaagaaaatgtatacctattggacttcataaaaattaaaaacttctgtgcatgaaaagatattaggaagagaaccacaatgcaatccacagaccagaaacaaatatttccaaatcatatatctgataagagatgcacatgcagcatatatagaggactcctaaaattcaacaacaacagaaaacaaaccaattcaaaactgtggaaagtatttgattagaaatttctgcttaaaagctatggaagtgggcagtaggcatatgaaaagatacttaatgaaactaattattagggaaatacaactcaaaaccatagcgatataccacctcacgctcactaagatggctactattttttttaaaaaatgaaacatcaacaagtcaggaaataagtgttggcaaacgtggtgatattggaacatttgtgtcttctggaatgtaaaatgatatgactgttatgcataaccctgtgtgatttctcaaaaaattcaaagtagaattactatataattcaacaatttcacttctgagtatgtgtccaaaataaacaaatacacagacctacatttttgtgtactgaaaaatatggtattattactcacaatagctaaaatgtagaagcaacccaagtgtccattgctaaatgaatagagaagcaaaatgtggtatatgcatacagtggaaacttattcagccttacaaaggaaggacattctagcatacattacaacatgcatgaaccttgaagatattatgctgaatgaaataaatcaataacaaaaagacaaatactgcatgattccatttacacgagatacttagagtggtcatattcatagagacagaaactagaaaggtagttgctaggggagttgggaaaagtgaatggggagctattgtttaatggttatagtgtttgttgtgccagagaaaagagttcttgagatgaatggtgtagatggttgcataataatatgaatgtacttaaatatcactgctctgtaaacaaaaactggttgagaaggtcaatttcatgttatgtatcttttattaagaaaagaaagaaacccctactgtaacaaaaatgaataatgcctttgattggctcatcaatagacaggacagggctgaggaaacaagcacaagcctgatgaaatgtcaatataaattttcaaacctgaaatgcaaagagaaaaaagaaaggaaaaagacagaacagaatattcaagaactgtgtgacaattacacatggtataaatatgtataattgaaataccagaaggaaaagaaagaaagaaaggaacaggagaaatatttgaattggcaatggctgagaatgcccccaaattaatgacagacatgtattcacaggtctaggaatctcatagaacaccaagtaggataaaaactaaaaagtatacatctacacaaatcatagacaaactgtagaaaatcaaagagaaaaaaatattgaaaggagctggaggaaaaaacaagtatcagaggaattcctattgttattttactctatcttcctgcttcctagtttcctaaccaagccctttaaagggaaatgcacaatagtatgagtagacaaaagacccaccttctagtgagaaggtcagagggcgttccctgggatccagtggacatggtgaagatcactgagaataattgatgtggtttgaatttgtgtccccacccaaatctcatgtcaaattgtgattccccagtgttggaggggggacctgatgggaggtgactggatcatgaaggtggatttcccccttgctgttctcatgatagtgagtgagttatcatgagatctgcttatttggacgtgtgtggcacctcaccctgctctctcttcctccttctctgaccgtgtaaaacattccttcttcccctttgccttctgccatgattgtaagtttcctgaggcttccctagccatgcttcttgtacagcctgttaattagaccttttttatttataaattaccaagtctcaagtagttctttatagcaatgtgagaatggaccaatacagaaaattggtactgagagtggggtatttctataaagatatctgaaaatgtggaagtgacttggaactaggtaataggcagaggttggaagagtgtggtgggctcagaagaagaaaagatgagggaaagtttggagctccctaaagacttgttaatttgttgtgaccaaaatgctgatggtgatatggtcaatgaggtttaggctgagaaggtctcagatggaaataaataacttactaagaactagagcaggccgggcattgtggctcatgcctgtaatcccagcactttgggaggctgaggcgggcagatcacctgaggtcaagagttcgagaccagcctgaccaacatggagaaaccccatttctactaaaaatacaaaattagccgggcacggtggtacacgctgtaatctcagctactcgggaggctgaagcaggagaatcactttaacccgggaggcggaggttgcagtgagccgagatcacacccttgtactcctgcctgggcaacaagagtgaaacaccatctaaaaaaaaaaaaaaaaaaactagagcaaaggttacttttgtcatgtgttaacaaagagtttggaagcattgtgcccctgttccagagatctatggaactttgaacttgagaaagataatctggaactggtacttatattttaaagagaagcagagtataaaagtttaaaaacttgcagcccagccatgtggtagaaaagaaaaacccattttctggggaggaattccagctggctgtagaaatttgcatacgtaaagaggagacaaatgttaattgtcaagaccatggggaaaatgccttgaaggcatttcagagaacttcctggcagcccctccaatcacaggcctggaggcctaggagggaagaacaattttgccaccaggcccagggcccttctaccatgtgcaacctcaggacatcgctccctgtgtcccagccactccagcttcagctgtggctaaaaaggccacagatatgtctcaggattctgttccaaagggtgtaaaccataagccatggcagcctccacatattgttaagccttcatgagcataaagggcaagagttgaggcttggaagcctctacatagatttcagaggctatatggaaatgtctgctgcagggctgcagccctcatggagaacctctgctagggcagtgcaaaggagaaatgtggggttggagcccctacacagagtccccaccggtgcactgcctagtggagctgtgagaagagggccaccatcctccagaccccagaataggagatccactgacagcttgcatcatgtacctagaaaagccacaggcactcaacaccagcccgtgaaagcagctgagggggctgtaccctgtagagccacagaggcagagatgcccaaggccttgggagcccaccctttgcatcagtgttgcctggaagtgagacatagagtcaaaagaaattattttggagctttaagatttaatgactgcactgctagatttcagacttgtatggggtctgtaacccctttgttttggctaatttctcccttttagaacaggagtatttagtccatgtctgtaccctcattgtatcttagaagtaactaactggttttggttttacaggctcatgggtggaagggacttaccctgtctcagatgagactttggactgtggacttttgagttaatgctggaatgagttaagactttgggggactgttgggaaggcatgattgtattttgtaatgtgaggagaacatgtgatttgggatgggccaggggtagaatgatatggtttggatttgtgtctccaccaaaatctcatgtcaaattgtgatccccagtgttggagtggggccctggtgggaagtgattggatgatgggggtggatatccctcttgctgttcttgtgatagtgagtgagttctcatgagatctggttgtttggaagtgtgtggcacctcctgctgctctcttccacttctctgaccatgtaagacatgcctgcttccccttcaccttccagcatgattgtaagtttcctgaggcctcccaagctatgcttcctgtatagtctgcagaactgtgagttaacttctttttaaaaataaattacccagtctcaggtggttctttataacaacacaagaacaaaccaataatggcagcaaatgtaagaaagaacactttaaatttgatagaatttcctgcatcaacccaaggtgcccatgcaggaatctttctattaatctaggattggagaactggactagagatagagcattacccagttctcaaccctgagcaggaccactcacaacccatggattcaaatatcatgacagcagcaacagcagaatgtataatacattttttccagcacacatgcaacactcaccaagctggattatcttctgagtagtggaacacacaataaactgatcatgaggtcaggagatcgagaccatcctggctaacacggtgaaaccccgtctctactaaaaatacaaaaaattagctgggcgtggagggtgcctgtagtcccagctactcgggaggctgaggcaggagaatggcatgaacccgggaggcggagcttacagtgagccaagatcacgccactgcactccagcctgggtgacagaacgagactccgtctcaaaaaaaaaaaaaaaaaattgaaatcaccgagtatggtctctggcctttcatggcatcaaatttgcaatcaaacaataacattaatacagcaggaaaatctgaaaccacttagaaactaaatcacacaatcttcaacaattcaaggatcacacttaatctcaacaaaataaaaaatccacagaactaagttaaactgaaaaagcaacatatcacaacttgtaggatgaagctaaaacagtgtttagagagagaattacagcagttaacacttagattaagactttttaaaggtctcaaataatctaagcttctaccttaactaactagaaaaagaagaaaacaaattaattcaaagcaagcagaagtagaaagtcaataactgatattaaaaagagaaaatacataggaaaaaaattaagaaaccaaaatctagttctttgaaaagataaagaaaatggatggaactctagtcatccagacaaagtaaaaagaagacacaaattattcaaatcaggaaggaaacaggagttatcattacagaacctgcagacattagaaaggtaaaaatgaaatactgaaaacaaatatatgcagaaaaattcaagaattgagatggaattggtgatgaaattaaataaatttcctctaaactcagaaactaccagaactcatcttagctgaaatggataacctgaatagtactctagctaataaagtaattgatttcatagtaaaaatgtttttgaaaattaaatatgtagacccagatatgttcactggagatatcttacaaacatataaggaaaacgtcacactcatctggacactaatacagcaaataaaagagaatggaatgttttctgaatctttttatcaggttaacattactgagctattaccaggccagcagtacaaaaaaagaaaaaaaagaaatataaaggaaaaaattagaggccaatatgctttataaacatagatgtgaaaaatctccatcaaaacctttttgaatagagtacagcaacatctaaaaagtgggatttttctgggaaatggaaggctggttcaatatttgataattaagcaatataattcactatctcaacagactaatgaaacttatgatgatttgaactaaagcagagaagagcattgagaaaatacaacatattcataatcagaagtctcagaaaactagatgtagagaggaacttaacctgacagagtacatataccaaaccctagagcaaatatcaatgtagggaaagactaaatgccttcccctaagagcataaacaagaaaagtatgtctcctctcaccactcctattcagcaatgtagtgggattcttaccagtgaaatcaaacaagaaatataaataagcagcatccagaatggaatggattagacaacactatttctaacctcagaagacatccctgtctatgcagaaaatcccaaggaaactgcacaataacttctcaaacaagtgggtgcagcaagctcacaagatagaaactcaatatacaataatcatatttctatgtaatggcaaaaaaagtggaaaattgttcttgccatttcttcaggttgtgtcctttgctctgcctagtctactgttcagctcatcaaagtcattcttcattttcgttatagtatttttttttatttttagcatttccttttgactcttttttacagagtttctatctttctgctgatattacttatctgctcttggacattatctactgtttcctcagagacctcagcacatccctcaaagttgttttaaattcctagtcagggctgggcatggtggcttgcgcctgtaatcccagcactttgggaggctgaggtgggcagatcacgaggtcaggagatcaagaccatcctggctaacacggtgaaaccctatctctactaaaaacacaaaaaattagccaggtgtggtggtgggcatctgtagtcccagctactcaggaggctgaggcaggagaatgatgtgaacccaggtgtgaacccaggaggcggagcttgcagtgagccaagattgcgccactgcactccaacctgggcgacagagcgagactccatctcaaaaaaaaaaaaaaaaattcctagtcagattattacaatatctctaccatatgagtctgtttctaatgaatgctctgtctcttcacactgcgtttcttgtgtattatggtttgaaattttttgttgcaaatttgacgtaatggaatggataaaaacaatggagttaaataggcctttagtgtgaggctttatgttcatctggctgtgtttactgtttgctgtagctgtaggtgtcagaggctaaacctccctgtggtatccttcatttttcctccttggttgtgtttggttttccttggagacttgctcactatgatctggcactcacagttctttcagtttcattcccccattgatgtggcagtgagctgtggagggaaggaaaatgttctatcctcctatgactaggtgtcaggcttgaatcagtgtgccctgggctgtagctttcactagtgcttctcagttttgttttctccttgaagacacaaaaggctggatggtgttgtaattggatatttcccttcccacaggttggttaaagtctagaaaaaaacccagcaagttagactctggaaaaataatttatctggtaagaagaacagaacactctgggcatattttctaatgaattctttccaatctttttacaggaagtaggaagggatttttctgaccaactctactggacttggccaaatccaaaggaaagttccaaattatggggaacaaggtctctgaattggctaaattcatgcagctggaaaaaaaaaaaaagaaaagaaaaaaaaacaagaatttgattacctgtggtgctttatttacataagaaggccaccttttagtagacaagccaaactgaaacagcaatggttgtagtacactagctaagcttctgcctttttttcacaagacagcctgcatttgttcctaaatcaagtcctttctggtttgatatttttgttacttttgaaatatcagcagtttgtcccagccaaaatatggtaatgagatttaaaaggattttttttaaagagcacaatggttaaaaatcagcttaattaaaagctaagatccaagatatatatgtttgtgtgtgcctgtgtgtgtgtgtgtgtgtctgtctgtctgtgtctgtgtatgtgttatatataaagtttcggtgccacaaaaggaatagcactcaaatataaaattttctttttaattctcagcaaggcaagttacttctggtgagcgcacacttggacaagggaggggaaggggttcttatccctgatgcacgtgacacctgctgtgtcattcccctgttagttagggttagactgcagaggctaaactaattccgattggctaatttaaagagaatatcgggttgagtgctttggcaggagtcaggacagagcaggtagcaggtaatctgaatgagttagggtggagcaggtgatcagaatgagttagggtggagcaggtgatcagaatgagtcaaggtggagtgggaaatagaaaaaggttgctttacgaggaagttaagtttaaaagtagaaggcaaagaattgaacatactgacatattatttgaaaagaaatttagaactcatatctaacaactcctccccttgtatttccttacagctttcttttcaaacttttttatttttttaacatgtcttggcttagttgttttgcttggttttccaaagaagaagtgtctctggataaagtggaggatagttaagggaggttttagtaagtgccgtttttatgagcctctgcatcaacttacagatgcatggtatgacacagcacccaacaagaataagtacacccattacgctgcaagggaaataagaatcgaggctattattcctttccatttactgaactacttttctagccatcctgtaaagggaccatttacccaagttgctggctagctcattggatagagcagtcagaccttgcagtgcctttgttatacttccactaggggtggtgttgtttgggatgaaggtgcaacactgagttgtaatcatgatgcaaactcctcctctttctgctaatatcatgtctacggctatcctattttcctaagccgtctcgctagcagccgctaattgttcagctatttaacagcatctctagtgtagttaataaattgctgttggttgcaatagatgtagtttatccaatctacatttttattaattgtcatccaccaaagtattgactcaaatcctgcagctatttgatttcgggctttaaattgatctggtattccctgtgggactttaattgtgtctaaatagatgtgagagtcaaaagacccataaggggcttctattgctttatggtgtcttattttttccttcctctggttgatgaaatgccagggtgaaagggatagccaattggactaaagcacaagtgccactccagttatttggcagtgttcagtaaaggtccaccacaatactaccacacatccacttggggatgaacaagggctgactgattgataagctcttgaaaattcttaagctcactgcatcccttcaggtctccgagtaatgctaagtttcctccctgtagtgaaagacacgaagtgaacttggtgttgggagacagaagctggatggccctcggggtctcactcgcagggtgccggactttgggatatagcagagagggagcttggcacgacttattactccaggctgtagaatcctggaaaagagctaccatgcagcccataccttgtcaactggaggaccaccttagtcgaaaagggacaatctgggcctctggcctgccgtgtgcaaagcataacaattgcttttgtttaacatgtggaccgaatatttgatccattccaaccaggcatttgcatcttggtatcctgtcttaattgccaaagtttgttttaagtctttaacttctatgatcctctagtaaaatgaatgtatagttttaggaaattacaaaaactggttggggcagtccatccttgctctttagtggtccagaaaacgttggaccaactactgcataaaagctgtacatcagggagcaagactcctggttaacactggagtctttatcgaaatctccccagattaaatggtcctaatttactaatgcccagtctgaggagagtcaggagggacagaggtacttttctgaagtagagagctgtctttgacttggcaagtccccacagggtgtaacaaggcaagcatcaaatccaatagtttgaggtgaaattgacttagttatgttaataactagatggtcagcaatagagtgaggaaagaagaaagagtaatagaagaggtgaaagagagttaaatttttcttagctttagtttggtagggtttttccctgagactatggcccacaactctggagggggtggcactttcttgacttgggtgtgatgagtccatccctttttcgctgtaccaacagcagtcttggtggttagcagtacaaggtagggtccttcccagagtagctcgagttttccttctttccaccctttgatgagatcatgatcttcaggctggtgctggtttactgtaaaccaggggtggtacctgtgctaagacttttagttttgagggaaaggaaagtggaagataaaccaagtatataatttctaagaaactgaccttttgttttaaatgtgaggacatcagcagtggactttatagtccttggtgccttcttactgagaaatttcttttcgcacccatttttattagtttttagaccaaagaaagccaaacatcattttatatttgacaatgcttcctgtatgatttttataccagataagctaaatttcacctttatattagtgtgttattaatgttaaacttagttttaataaaactttgtagacatacttattcgatttttaatgtctgaccataaggtaagatttttatagactctttaaccttttatattttttgttaaagagcaggttagtgctttcagaaaaacctgctgtgcttttattttgctgttgtttgaaatgcttgttccccagtgctgtaaataaatagcacttgaacataaatttaatttatttaataaggccatttttacttcctacagaaagggtacactcgccagcagttttgccatgagagtacaccaaacaaaggagacagggtcatttataacctgacatgtccaccctactgctgtgtctggtttccattggctggaacgggacctcacattctttatttgtcccgattggctagcaacttagagctttttaaaagaggcaaaggtagaggagaacaaaggaaggaggaagtaacttgtggaatgctgagaaaggtaaaaacacttttaaataaggaagaggaacaggctatgacctaatgcttgcttggaccagtataagcatgccagggcaaatacttaggagcacaggtctttgaataaattttgcttctaagagaagttactatttattcctaattagatagggaggaaagtctttgaagaggaacctctactttactttttacaatattccccctctttttatttcataatttctcttcaaacttatttaatatgttttgacttaattgctttgtccctgtaaaagaagtaatttttttttgaatagggtggaggagagttaggagttaactctgtaagagtggcagagacaagtttttgcataaaactttgaaggcagggaataatataacagtctacaagaataagtacaccaataataagaacgaacaaggtgagaattgaagttaaatttttttttaatttatagttacctattagaacaacgtggatttaaattttgcatctatttgattttgtgctttaaaattatttggcagttctcacaggaccttaatagcatttatataaacctgaggattaaaggacttacaaggagttttccttggcctgcggtgttttgtttttacctttttagatggatgaaatgccagggtgaaggggatagccaattggattagagcacaagtactgctccaattatttggcaaagtgtctagtaaagatcctctacaggattaccatacatttgcttggggatggctaagcatggactgatgggcaagctcttagaaaggcttgagctctttatatccttttatgtttccaagaaacaccaaatcttccccctgccatgagaggtacaaagtaaacttggcatttagaggtggaagctggattgccctcaggggctggcccacagggggttgaactttaggagatagcagagagagctcagtaggatggattattctaagcagtgggattttgaaaaagagccaccgtacagtccgtatgtggtcaatggggagaccattcgaatggaaaggggataatctgggcctctggcctaccgtgcatacaagcgtcataatcgcttttattaacggattatttaatcaatttcagccaggcatttgcaatttgatattttgtcttgacggctgtttgtcttaggtctcttatttttataatagacaccctagttttattagatgtaggagcaaccggtgtgagatctagaactgaggctactgaagaaggggaagatgggggaataatgcatattttaaaaatacttatgggggtcttttccatttacgtcaatccttatactatagaagcgactaagggcaggtttagagttagttaaggtggaggtggtgatagagagaaggacggggttatattgataaggctgacagttagaaggggtagtccttttagtgaaatagatgagggattttagatctgcacaaacctttttcgtggaagtttaactttgctcctgagtagtttaatggatgtagtcccatttactacaaggttgccagcctgtaggagcagaaaattggcatcttggctgcatgtgattacaacaatgagtgctaggggtaaccgtgtcaattagagggctgggacataaatatttgtgtgaaaagactagctgttgttgatcttttacatttccacaaggtatgacagcgcaagcattaaaggcaatggtttgaggtgagttagatttagttacattaataacaaaggagctagtaacagaataaggaaaggaaaggaagcaatatagaaggtatatgaaaattaagctttctttaacttagtagggcttgatcctagtacagtaacccacgattttgagaggaagttttttttgactcgagtatggtgggtccatttttttttgtcttggctgtgcggacggcagtctcagcagttaacagcataaaatagggttcttcctaggctggcttgagtttttctatcttttgatgaggacgtggttttcaggctggtgctgatgtactggaaattctaggggtggcacctgtgctaaaagacttttagttccaagggaaggaaaagtggaagataagtatataatttttgctgcatattctggggcttgaggcctcatggtgacgcctcctgctccattcttgctcagtgccacctaggggatgctgcagtcctgccccttcttaatgtcttggccttcttgtggccttcactgcccctgtgcactgtgaccttgaggatgaggggccttgtgacttacctggctgcctttgggccttaagaaagctaaacaccattttatatttgacaatgttttttatatgattttataccagataagttaaattttatctttatattaatatgctattaatgttaaacttaattttaataaaattttgtagacattatctaattttaatgtctgactatagttaaattttatctttatattaatatgctattaatgttaaacttaattttaataaaattttgtagacattatctaatttgaatgtctgattataaggtaagacttttatagactctttttaactttttataatttttgttaaagagcaggttagtgcttcaagaaagatctattgtgctttaattttaacgtccagttcagaaaaactggatgatacctctttaactttagccagtatgtttacacacagaatttcctttacaattaactttttaaaacttgcttaaacctttaaaacaaaaaaaaattttaaacctttaatgtaggtaaaaatccacattcttatgcctccttaaaatcctgttattaaaagtatattttatgtttcttacataccttgtacataaactttttaaaaataattttacattcaggaggcctaattacttttaaattatacaatatttcttgcataaattcccttttatagcttttcttacaactttcacaatctgcaacatgtcttaactttgtgccttccttttacactatttctttttctagtttcaccctctatgtctttgatttctgtctcttccagtttctcttacttaccctttccatttctctttctctctcatttgcactgtatttctctctctctctctctctctctctctctctccctcatcctctgtcatcctttgtcatcctgtttccctttcttttcccgagttctcttgctcctgccgtgagcggggaccagccacggccgccccctacgcgtgcgcggccggctgtttctcctgtgttccccccctttactttcttttttttcatttctttttacacttagtttctcgggctgggtgagatttgcgtggctgcagtctgggcctagggcagtcaccagcctagaggcttggcagatgcctgccgcaaattgcaagaattatgccctattcagctcctctgctctcctcccagcaagggtccaccgccctctttttcacatagactggggctggggagagggacttaacccttggcgtgcctgcctcgctgtttggctctgtgactgctgtttttgcttgctttctctcttctctcctaagttctttttcttctctgctggtctttccttagtctctgccagccacctatgctgctgtttttccttctcctttcccttcccttaggggagggaccggcgggagtggagctactctttcttcccctgagaagaaaggaaaggggggtttctaaatatttttcttacttccggaggtttgtgtgaggttcaacccccccaccatggggatttctcacctctttctgaggttcaacccccccaccatggggatttctcacctctttctgaggttcaaccccccccccaaggaattctcagctctttctgaggttcaacgcccctggggatttctcacctctttctaacctccaggacatcctgactaaggcatactttaccacccctgcagtttttttactttactggctcctgcggcttctccttccttggtctgtgcacagagtcatcactgcagtatgtgaggatcctttaagctaggttgctggccagtttctggttttttttttctctctctctctctccctctttttatttttgcattgctgagagtacaggtttattcatcacaccgggtgggtctcaatttctcacccatgagacgcttgcaatgaggtaagggagcacgctccatcatgagagacgactggagaccacccccagaggagaatgtatccccatatggcccatcaaattgtttgaaatgcttgttccctagtgccgtaaagaaatagcacttgaacattattatttagtaaggccatttttactttctgcagaaagggtacactcgccagcagttttgccacgagaatacaccaaacaaaggagacagggtcatttatgacctgacgcatccaccctactgctgtgtccggtttccattggctggaacgggacctcacattctgtattcgtcccgaatggctagcaacttaggagtttttagaagaggcaaaggtagaggagaacaaaggaaggaggaagtaaattgtggaatgctgagaaaggtaaaaacacttttaaataaagaagaggcacaggctatgacctgatgcttgcttggaccagtataagcatgccagggcaagtatttaggagcacaggtctttgaataaattttgcttctaagagaagttactatttattcctaattagattggaaggaaagtctttgaagacgaacttctactttactttttatttacaatgtccagttcacagaaaaactggatgatacctctgtaactttagccaatatgtttacacacaggattccctttacaattaacatttcaaaacttgcttaaacctttaaaacaaaatatttttttaaccttttaatgtaggtaaaaatccacatcattatgcctccatataatccttttaccaaaggtatattttactttccttatacactttgcacgtaaactgtttcttcaataattctacattcaggaggcctaattacttttaaattatacaacatttcttgcataaattcccttttataacttttttttggtcatgactttcacagacaattcttccatgtgcctcaactttctgacttgctgcaaacatccttttctttaaacaaccagttaatttactttaggacaagaatttaccatataacattctttttacataaattcccccctccaccctttttttcctaaagatgataaccattcttttccaaagcgaacttccttcatgtctgtggactagactgcctaagaccataagattagaagttaggataatacatgttacactgttaacttttagcaaactttacttttgttgaaaaccttgtaagtttgggatttcaattatcctttgctgttaacaagaccttgtttagtccagatttacttagaattggcatagatggttccttcctggttctttaagtactttaaggcttggctgagaggaaacagctctcaggtttgagcagaccaattattaggccattttcctaactctgcttttacaagagtttccctatcaattactgaatacctattgtgtctttttccctcagtcaccagggaggaaccatctattgtcctgtcctgaagggagttcctcctaggtatggtcagacctttgtatggtaattaattaagatttagatcccctgttaggaaacctgctgggttaagggaattatccgtggttaatgttaaatcatctttttctaacagaagagtcccatactttaagatttttgagttagtaagctacctttctgctttttttttttttttttgacttaagatagttctgaacttgtgaggtgtgcttacaatgaagtttcctctaaaagcgatttttctactttcttctgctagcaaagcagttgctgctacagattaaatgcatttgggccatccgcaggttaaggattttagataggaaggctaagggttgtcagtggcctaagtgctttagggctatgcccttgtttacactgacaacaaggtggtattggagtgttatagggtcatggagaagaccttcaattatcaattataggttttaaatttaccctggcttttaaaggaatagggtacactgtttcttcttcactacttctatctttctttctttgactttctgtctctctcctctctttctctccctttgactccgtctctgcctctctctctttgactccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccctttcctagccaagggaagccatgacagacagtacctggaaaattaggacactcccaccctaatactgcacttttccaacagtcttagcaaacagcacacaaggagattatatcctgcgcctggcttggagggtcccacgcccacggatccttgctcactgctagcacagcagtctgagattgaactgcaaggcagcaacaaggctgggggagggacgtctgccattgctgaggcttgagtaggtaaacaaagcagctgggaagctcgaactgggtggagcccaccgcagctcaaggagacctgcctgcctctgtagactccacctctgggggcagcccatagctgaacaaaaagcagcagaaacttctgcagacttaaacgtccctgtctgacagctttgaagacagtagtggttctcccaacacagagtttgagatctgagaatggacagactgcctcctcaagtgggtccctgacccccgagtagtctaactgggagacacctcccagtagggactgactgacacctcatacagcccagtgcccctctgagacgaagcttccagaggaagaataaggcagcaacatttgccgttctgcgatatctgctgttctgcagcctcctcgggtgattgatacccaggcaaacggggtctggagtggacctaggcaaactccaacagacctgcagctgaaggtcctgacggttagaaggaaaactaacaaacagaaaggacatccacaccaaaaccccatctgtacgtcaaagaccaaaggtagataaaaccacaaagatggggaaaaaacagagcagaaaagctgaaaattctaaaaatcagagtgcctcttcccttccaaagaaatgcagctccttgccagcaacagaacaaagctggatggagaatgactttgacgagttgagaaaagaaggcttcagacgatcggtaataacaaacttctccaagctaaaggaggatgttcaaacccatcgcaaagaagctaaaaatcttgaaaaaggattagatgaatggctaactagaataaacagcatagagaagaccttaaatgacctgatggagctgaaaaccatggcacgagaactacgtgacatatgcgcaagcttcagtagctgatttgatcaagtggaagaaagggtatcagtgattgaagatcaaatgaatgaaataaagcaagaagagaagtttagagaaaaaagagtaaaaagaaacaaagaaagcctccaagaaatatgggactatgtgaaaagaccaaatctatgtctgattggtctacctgaaagtgacagggagaatggaaccaagttggaaaacactcttcaggatactatccaggagaacttccccaacctagcaaggcaggccaacattcaaattcaggaaatacagagaaagccacaaagatactccttgagaagagcaactccaagacacataattatcagattcaccaaagttgaaatgaaggaaaaaatattaagggcagccagagagaaaggtcaggtttcccacaaagggaagcccatcagactaacagcggatctcttggtagaaactctacatagaagccagaagagagtgggggccaatattcaacattcttaaagaaaagaattttcaacccagaatttcatatcctgccaaactaagcttcgtaagtgaaggaaaaataaaatcctttacagacaagcaaatgctgagagattttgtcatcaccaggcctgcgttacaagagctcctgaaggaagcagtaaacatggaaaggaacaactggtaccagccactgcaaaaacatgccaaatcgtaaagaccactgatgctaggaagaaacttcatcaactaacaagcaaaatcaccagctaacatcgtaatgacaggatcaaatacacacataacaatattaaccttaaatgtaaatgggctaaatgctccagttaaaagacacagactggcaaattggataaagagtcaagacccatcagtgtgctgtattcagaaaacccatctcacatgtagagacacacataggctcaaaataaaaggatggaggaagatctaccaagcaaatagaaaacaaacaaacaaaaaagcaggggttgcaatcctagtctcggataaaacagactttaaaccaacaaagatcaaaagagacaaaggccattacataatggtaaagggatccattcaacaagaagagctaactgtcctaaatatatatgcacccaatacaggagcacccagattcataaagcaagtccttagagaccgacaaagagacttagtctcccacacaataataataggagaccttaattccccactgtcaacattagacagatcaagacagaaagttaacaaggatatccaggaattgaactcagctctgcaccaagccgacctaatagacatctacagaactctccacccaaatcaacagaatatacactcttctcagtaccacatcacacttattccaaaattgaccacatagttggaagtaaagcactcctcagcaaatgtaaaagaacagaaactataacaaactgtctctcagaccacagtgcaatcaaactagaactcaccattaagaaactcacttaaaaccacacaactacatggaaactgaacaacctgctcttgaatgactactgggtacataacgaaatgaaggcagaaataaagatgttctttgaaaccaatgagaacaaagacacaacataccagaatctctgggacacatttaaagcagtgtgtagagggaaatttatagcactaaatgcccacaagagaaagcaagaaagatctaaaattgacaccctaacatcacaattaaaagaactagagaagcaagagcaaacatattcaaaagctagcagaagggaagaaataactaaaatcaaagcagaactgaaggagacagagacacaaaaaacccttcaaaaaatcagtgaatccaggagctggtttttgaaaagatcaacaaaattgatagactgctagcaagactaataaagaagaaaagagagaagaatcaaatagacgcaataaaaaatgataaaggggatatcaccaccgatcccacagaaatacaaactaccatcagagaatactataaacacctctacgcaaataaactagaaaatctagaagaaatgaataaattcctggacacatacgccttctcaagcctaaaccaggaagaagttgaatccctgaatagaccaataacaccctccgatattgaggcaataattaatagcctaccaaccaaaaaacgtcgaggaccagacagattcacagccgaattgtaccagaggtacaaagaggagctggtaccattccttctgaaactattccaatcaatagaaagagagggaatcctccctaactcattttatgaggccagcatcatcctgatatcaaagcctggcagagacacaacaaaaaaagagaattttagaccaatatccctgatgaacatcgatgcaaaaatcctcaataaaatactggcaaactgaatccagcagcacatcaaaggattataaatcatgctgctgtaaatacacatgcacacgtatgtttattgcggcactattcacaatagcaaagacttggaaccaacccagatgtccatcaatgatagactggattaagaaaatgtgacacatatacaccatggaatactatgcaggcataaaaaaggatgagttcatgtcctttgtagggacatggatgaagctggaaaccatcattctcagcaaactatcacaaggacaaaaaaccaaacaccgcatgttctcactcataggtggaaattgaacaatgagaacacttggacacagggtggggaacatcacacaccggggcctgtcgtggagtgggaagaggcgggaggaatagcattaggagatattcctaatgtaataggaatgtaaatgacgagttaatgggtgcagtacaccaatatggcacatgtatacatatgtaacaaacctgcacgtcatgcacatgtaccctagatcttaaagtataataataaaacaggtaaatatacatacatatacacatacacatacatatatatatatgtataaagcaagcatatatatatatatcaggcctttatgctttctttctcttctaggatattattttttttgacaaaaagggattttttttacccttctcagtcaactgaattctgttttctccatttatttctgcctgtctcttcttgctactctctgctgcataagggaccttaaataattttgaggtttgtaaaattagatttttttctaatttcaaaacacctcattagatatatatggttatatattatatattttatatgcttatatataatttatatgatttaattttctatatttaattaacttaaagacaaaaaagtgctaaaagactttatcagaaaaatagaagcccagatgctttttttttttttttgagaccgagtttcactcttattgcccaggctagagtgcagtggcacgatctcggctcactgcaacctccacctcccaggttcaagcgattctcctgcctcagccttcctgagtagctgggattacaggcatgcgccaccatgcccagctaattttgtattttaagtagagacgggctttctccatgttggtcaggctggtctcgaactcccgacctcaggtgatctgcctgcctcagcctcccaaagtgctggtattataggcgtaagccaccgcacctggccccaactgctttttaaagttcacaggcaaaaatctctaaatggacacattgacaaaaaacatatgcagatggaaaataatcataagacaagataatcaacatcattcttcagaaggaaattgtgaattaaataaaagtgagatacacacgtattaggatgactaaaatccaaaaaatcgaaaatgccaatggctggcaacgaggaacaaaagacactgttggtcatcactgctgggaatgcaaagtagtaaagcaactttcaaagacagtttgtcagctgtttccattacaaaactgagcacagtctcttcaatcctaggtatacatccagctggtttgcaaacttatgcccacgcaaaaatcttgcatacaaatgtatgtggcagcttacttcatcattgtcagaaactggaagcacacaagatgttcttcaggaggtgaatggaaaaactgtgttccaacaacaacagaacattattcatcaaccaaaaaatgacccctgaggcacaaaaaacatgaatgaatcttaagtgcttagtgttaagtgaaagaagccagtctgaaaatgatagatagtatatgatctaatttacctgacattctagaaaaggcgaagctataaaggcagtaaaaatgtctgttgtggccagtgatctggggtggggagaaggtatgccttagataagcagaagggatttattagactggtgaaattattctctaggatactgcaatgatgaattacattatgtattctagaaataaacagtcctagccatgagtgatcagataaaacccaaaaccagaaactcatttttttctaaaatggtgatatggtttgactctggtccccacccaaatctcatcttgaattataatccccacatgacaagggagggacctggtaggaaatgattggaccatgggggcagtttcccccatgctgttctcatgatagtgagtgagttctcatgagatctgatggtttaaaagtgtttggcaggtccccccttgtgccctttctctcctgctaccatgtgagaggtgccttgcttccccttcactttctgccatgattgtgtttcctgaggactctgcagtcatgcggaactgtgagtcaactaaacctcttttgtttatatattgctcaggctcaggtagtttgttatagcagtgtgaaggtgactaatacaaatgctttgtctgaaagattttcagaagaaaagagggagaaatgtgaaagaaacataaaaatgtgggaccctaattcactatgccaaaagaagaaaatgaatctgaaaggtgagtcatgtaggaagctgcctttccttttgttcctaagcagatagctacagataaaaggttaaatatatccacaggtagctactctacgttcactttatcttacgtaaagtgccagtttaatgagggagagaggaatacataactggttatacccctacctgctcctattcctcttgcaacatgtgcattcagtaatgtgaccgtgccctccctcaatgtcctccagcttgcttttcccctttaaatattgaagccctcaaaatcatctctggagaaaggcacagacctacctcctgggcatgcccttaacattggcaaaataaacttccaaattgattgacacctatctcagatactttttagttttcagatgaaattcagggaaacaaactaaatgtaagaaattcccaagacacatgtcttttcaagagcatacctctcctagtcaacaggagatctaccaaaagaaatgtaataatgaaaaaataaactgaggactcttttctcaccctcacaaagaattttaagattaaaaaaaattagactagtgaagagaagggaagaacaaggaacaactttaatctctccctttcattttttatttcttttggtttagcttatgcaagattttgtatccatgaaagaatttaagtttattcaataaaaagtattaatgatttaaagccattaaagcaaaataaattgctaatggggtatcattgattgagttaagcaatacaagtttttctgtattagtaattgatatacatttaattttttaaaagacaccgtttgaataaggtcaccacaagacagatttacatacaactgtttattggaaaaaaaacataagaaagtatattatgtgatctgtacagatgtactctttccttgatcatatgaaaatgcagtctttttagaaggttatagctattaaatttagagaagtaccaaacaacaaatcactttaagcaaaactcttcatttttcagaaaacagtatgatttcacattttctattttggcatagattttaattctttccagtggaacctaaaccttctgaaggcctttcagtttcatccagagcttgaacttctgtttacggataaaaaatccattcacagaaaactggtgcaatttgatcactttttttgacttcaaacctttctttacccaaattaagcactacagtcccaccatttcctctataaccttcgtctgtgacaccagctcctgtatctataaagtgttttgcagccaggccagaccactgagccactcatccattgcagccagcaggaagagcagttttcacaagcgcttactccgtagatggtattgtataatcgtaggcactatacaggttatagtctgcggtcagccaagacccctggttcagggccatggcatgcttggagagcaggcaaagcacagctgcatgctgccctcctggcaggtcaggcctgcttgctgggggagaaatggcaggtgtcttttcagagcagggcatagcagagcaaaaggaaagcagaggagacagtccagggaacaagagaatacaggatgagccaacatttgctttgattaagtgacaattagcaccagtgtctccattctgtataggtctgttctgctagggcctggagacagaccttagtccaaaacaatcacctaacatgagttcacttatcacaaataactaaatttcataaatggggaaaagatatcaatagacacttcccctaagtggacatatgcatgacaaataaagacatgaaaaatcattgttcatcatatctattagagaagtgagaattaaaccataaagagatagcataacacatagtttaaaatgactgaaaatttctcaaaaaagatattactaagtgctagcaaggatgaagaccaatttaaaatctgatatgttgccagtgggaattatgaaatagtacaaccactgtggaaaatgatttggaaatttttttttctgactttacaatctttactgcatttattttaaaaaaatttaattatgttttggttctttggttcttcccaacttttatttttgtttcagggggtacctgtgcagatttgttgcatgggtatattgcgtgtctcagaggtttggtgtactgacgacttatcactcaggtaatcatcatagtatcagataggtggttttcaaattgtcaccctacccctaggctccactctccacattggtaaaatagtttccagtgtctattgttccctcctttgtgtccacatatgctcaatgtgtagctcctacttataagtgagaacatgtggtatttggttttctgttcctgcattaatttgcttagaataatagctccagctccatccatgttgctgcaaaggtcatgattttgttatttttaatggctgcatagtatttcatggtccatatataccacgttttctttatccagtccaccattgatgagcatctcagttaattctatgtatttgctactgtgaatagtgctgcgacgaacatatgtgtgcatgtgtctttatggtagaacaatttatattcccttgggtacatatccagtaatgggattgctgggtcgattggtaattctgatttaatttcttggagaaatttacaaactacttttcacgatagctgaaggaatgtacattcccaccagtagtgtatcagtttcctcatgacctcagcagcatcagtttcttttttgactttttattaatagccattctgactgttgtgagatggtatctcattgtaattttaatttgcatttctatgttagtgacgttggacactttttcctatgcttgttggctgtgtgtatgtcatcttttgagaagtgtctgctcatgttcttggcccattttttaatggggttgttttttccttattaatttgttaaagttccttatagattctggatattagacctctgttggatgtgtagtctgcaaatctttctcccattctgtagcctttctgtttgctgggttgatagtttcttttcacgtgaagaagttctttagtttacttaggtcttattctcaatttgggggtttttacaatagcttttggaatcctcatcatgaaatctttgtcaaggcccacatccagaatggtatttccttggttttcttctaggacttttatcgttttaggtttttcatttatgtctttaatccatcttgagttgatggattaaagatgaattcatcttgagttgaaactggaaggggctcagtttcaatcttctgcgtatggctagccagttatgccagcaccatttattgataggaactcatttcctcattgcttgtttttgtcaattttgttgaagatcagatggttatagctgtgtggctttatttctgggttctctaacccgtgttagagaagactatcatgttttggttactgtagcattatagtatagtttagagtcaggtcctgtgatgcctctggctatgctctttttgcttatgattgcttttgactattcaggtttatttctggttccatatggaatttagaatagttttttttctaatctgtgaaaaatgtcattggtagtttgttaggaatagcattaaatcggtaaattgctttaggcattatggccatttaaatattattgatttttcctaagcatgagcatgtaatgttttcccatttgcctgtgtcatctctgatttttttcagcagtatttgtaactgccactgtaaaggcgtttcacctctgattcgctgcattcctaggcattttatacttttgtattatgaatgcgattatgtttttgatttggctctccacttggatgttgttggtgtatagaattgttgctgatttttgtaccttgatttcgtatcttgaaactttgctgaagttatttatcagatctaggagcttctgggcagagactatcggggctttcttggtgtaaaatcatatcatctgcaaggagagataatttgacttcctctcttcctatttggatgccttttatatctttgccttgcctgattgctctggctaggacttccataatatgttgaataggaatggtgagagtatgcatccttgttttgttctggttctcatggagatcacttccatcttttgtccattccatatgatgttggctgtgggtttgtacatagatggctatattattttgaggtgtgttcctgcagtgcccagtatgttgagggcattgtccagtgtggacacatgcatgacaaagaagcacatgagaaattattctacatcacagctattagagaaatgcatattaaggcataatgagctacagtaacatatatttgaaaataacaaaaaaaaattttaaaagacattactacatgaatgtttacagcagctctagtcatatttgagaaaacctgaaaattacacaaatatatttttgtggataaatggacaatgaagtttttgtgcatccaaactatgaaataactactctgcaataaaaggcatgaactactggtatgcacaacaaggtgtatcaaactcaaagatgtcttgctgtgtggaaagagccagtctcaaccaggtacatattctattttttctattcatgtgacattcttgaaagagaaaactgaaatagtgagtacagatgagaggttcccactgttagttgtagacatgtgggtataactataagtgtatagcaagtaaaaggggtttctcttggagaggagggtgacggaattgtttgtatgaagattgtgatggtggttccatgaatctatacatgagcaaaacccacagaattggacagaaaaggaaaaaaacactgtttgtccatttaaataataaaattgaaaattaaaaagaaagctggaaaaacagaaaagtaaacttttaaaaactttatgggaaggaaaattaccctggataaatagggacattatgcaatgataaaagagtcaattaacaaaaaatacatcataatcctgttagttcacctaaaagcattgttttaaaatacatgaaacatctgatagaattgaaagaataaatagtcaaatctacacttgcatttggagattgcaaaactcctctctgagtaaatgattgaagtacacagaaactctgcaaggttatagaccaacccgaataacacaaagaaccaacttgagctgactggcttttactgaacacgtcacagaacaacagcagaataaatattgttttcaagtgtatgtggaatttttaccaagatagaccgtaaaacaactcttaacaaatttaaaataattgaagttgtacaaaatatacgttttaatacgaaaatgtattcatttcaaattatacatttcaatttaataattgaaattgtacaaagtggaaattttaaagatccagaataaaataaaaatataacaaaggacatatttgtaaagtctccatgtaattttaaataaacaacacatttttactcttctttgtttaaaaaattattaaggaaaatgagaaaatatattctgataaataaaaatggtaatatgatgttttaaaatatgtggaaatcagctaacgtagtgcctaatttttatctccttgagtgcttatgtaagaaagtaacaaatggctcaaataaaacatctaatcattgatgttaaataattagaaaaataaaagtaaattaaacctgaggaaaacaaaaggattgggatgatatagacaggaagagaaaaattaatgaaattgaaacttcagaaacttctggaaacaataaatgcaattgatgaaaccaagtgttatttttttcaatagatcagactagctaaaatgtcccatggcaatatgagaaatttgaacaatatagttgtggagaaacaacggctatgaacgcagccagaagtagaagaagctacatacaaactctaatttgttatgataactacactcttcatttcttatagacggttctgagaagaccagttttgccttgaaattctctgaatttgcaagtgtctaccacgtagcagatgctttcaaatgcattaacccatcaaattgaagaagatcctgcaaaagttagcagggagatttcaccttccatactccatagcatttaccgcacttccctttgcaatgccatctatcatctcaggaggctgcggatttcctccttccacctgatgcaggggcagaatcttacgtgacatatctgcttctctccacataactgttcttgcctaaacacctgtgcaggtgccactagtcacactgaaagccagtatgtccctgggtgcagatgccagacaggaggcagtggaagagtgattcatcattcttttcaaattccaggtggcatgtccatcaaggacgcatttctcataccccgggaggagcccagtgtttgtaagaattcagctttagaggatgggtgctcctcttctacctcttacgaaggaatggaatttctgagcactatctatttgtttgcctgttcagttcccagcttcagataagaagcccattaaaatcctactgcaaatatgtgagtggcttaaaaatctactctccaccttcagggctgtttcccaagagtcaggagattatgggcaaagtatagtctattcacagcccattgggaaaataaagaatgtgtatagaactcccagggagggaggaccaggtggctgtggctgtgggacaggaccgaaggtgagccgtgggaaagctaggggggttctgcaggggatagggatgctccatgttctggggaaagcaggggattctgtgcagcctcctgaggcagcaaggaagagcaagcaccaggctgggcctctgagttggaatggagggcacgtgagggcgaccaagggaagggtgttgtaactcgggaaagtgttggggccagacagacatgctggctgggagtgtacttgtctcttgtgcctttgacggaggaaccaagatgtggatgagcacttgtaggctctcccataacatctttcatagtaggtgctcaacagaaggcacccagcagtcagctcccaggggccccaacacatgccacccaaattctgtttgattctcattgtcaccttcttttggcctgcttttagtactttgtccccagggtccttccttttgtcacctgagagacatgatgcagtggtgagaaatgaactactgctcaggaagtgggcctcaggctgggaggagtgggagcagcttgggctccagtggaatcagactagagatctggttccagccctgtcacttactacccttgtgatcctgggacattctcaagccctgtgagcctcagattctttgtccgtgaagcatgggtaataggccttgaccaatagggctgttggagtgtatgtaatgtaagtgatgcacctggctcaagtcctgacacaaataagaagtttacggaatggcagatggcttttatttctagtatttgaccccagatcctagtattctgggattttcttattgttgttgtggttctccaggacttatcagaaactatgcaggcgaataggacatggaacaattactcggccaaaaaaaaggaagttttgtcaatgaatttcagttagtttaccctctcacggggcatacttcaaaatttcagggtgcagaaccctcccccaactggaatgcaactcaaagctcttagaatatgagtcaagaataaagtccttccctctctctcagcttcttttacatccaaaccacttttttcattgattatgtcacgacccaaaatctttcccttgttataattggccaaattgcacttcagataagctagttagaatgtctctttaatagagtcagctctggctcacacaaccaggaagaaaaacacctggccagtggcatctgagcctcacatcccaggagattcacgcttctctctaaggaaacccttccggatgatgggtatccatcaccaacttcgtgtgccgtgttcaactgcactgagacaagagtgcaggacacctcccattcctgccccaggaggagatgcctctctgtttcatccaccatccaaaaggaactgctgagcatgtttcccttccaagcttttctctcatcctctgagaatctggctctggtcctaccccatttcactagaatcagctctcccaaaaggtactgcagtttcccaaagcccaaaaggccttggctcagggcatgtacactccaccactctcacctgttgccccacaccctcacccctctcttatttttcctctagatgttggaggacatctgtccaccttagttatatgactgcagatcctagactcacccaccgtaaggttaggggtgggcctggcttaccttagcatctccaatactaacccagggacttacaaatagcagaagctcaatgaatgtttcaggacgaaatgagtcagtgagcaggggaatgcatttattcatatttaattcaattacattctcaaagaagccaagctaatccaatatgtattagccaagcaaatatgtatttcttaactacacagaatacaagaaagacaagaattaactataatttaatttttttttttttgagatagagtcttgctctgtcgcccaggctacagcagtgcgatctgggctcactgcatgctctgtctcctgggttcacaccattctccttctcagcctcctgagtagctgggactacaggcacccaccgcctcacccagctaattttttttttttttttgagacggagtctcgctctgttgcccaggctggatggagtgcagtggcgcgatctcggctcactgcgagctccgcctccagggttcacaccattctcctgccgcagcctccccagtagctgggactacaggcacccgccaccacgcccggctaagttttgtatttttaatagagatggtgtttcactgtgttagccagaatggtctcgatctcctgacctcgtgatccccgtgcctctgcctcctaaagtgctgggattacaggcgtgagccaccgtgcccagccaatttaatttctttatttctttatctcacccattttaccgctttgttctttcacattataaaaggtacttaatcctctgctatgttatgttgtcccaattcaagaaataacatagattttcttacataaataaaaaacaatgcacttacttttaactatataaaaaacagtaagtctgcctactgtcatacatgaaatgaatgttgaagttcattacaccatccattaaaaggaacatttgaacgactgcaaaaggaaacaaagataaacctccaaatcgcccaagagaacaggaactgagagatggtccaccttgtattccctcacacccaacacactccccgatactgagaacattgactgctctcttcaaacacagagtgaagaatgggcctcatgtaacaggacagggaaggtggtggatgtgtggaacgtgcactggcccaggccctcccccaatctgccccactggccctggctgcaacttctgctcagactccctcttcctcctctcccaaagcctcttcatgcagggatgggtaggaaatgctctctttagtactgaccctggctgcatactccaggactttcacatagctggtttcaatgagggcccttggaccccacaggaactggtagcacgggggatcactgctgggcacctggcggtattgcaggtagttttcctgcacccaatcttgggtgagcagcttcctcagctgcccaaagaaactgctccatcccatcatacaccattacactcaacgcttcccagattgcctcctcaggggcacagtggccctccattaagatcatggtcaagaccataatcagaaggccggtctcgggcatgctctgatcatcacccagcaggccattgtaggagaggcccaagcaggtgacaaggacgtaggagtggccgcggggtccacttccttcatgtcaatgccaaacatcacctgcatgcactctgaggctttgccatagatcacaggaaactagtgcttgtaatttttgatgacactgtccagcatttctgcctttgtgaccagctccttgactcgatacttgtgcagcaggaagcgaaccaactcagccaccttcccattggaacaaggacgccaggtgagcggggtgtgtctaggtggttggcccctcctcttcccggctgctggtgccctcactggattggctccatagagtgttgttgctgatggtcagggaaaaggaggaaccctgagactcaggggaggactgggggacccagcagcaggcacctcctccagggtgccttcaatcagagtgaaggaggaggcagcctcgtgctcctcggtggcgggagcctgcacacccaccaggcccagagcctcctgtccttgggcctcaaggccatcctcaggcttgcagtgctgactcctctgctcagaagacatgatgactctggtcagggcagcaggctggagtgcgggcagcagctgggcgatggggaggaacccacagatctggggagagaaggagcttgtgaggggcctcatttgtgaaccacgccctggaggccctaacaaaggcctacttacagatcttctccttcggtgctcctctggggcctcctggggcttctgacctcctggccggcctgtccgctgagaacctgaaggaggaagtgagagggcacctcagggtacagccggccagcagaggctgaggctgcaggactgacagtagggaaggtgaggctgggctctctggagtcccttgtgttctggggagtgtggggcccttgttgtccattcagatcagaacctcgccttgactgctaacactgcctgcgactcctctgctctgtgacctgagcacagtgcctcagaccaaggcctaactgcctggttcctggagctcctaaaagaggaatcgaggggccctcagggtgcagactgcaagcacagccctggctttccagtgctgtcagaagggttgaccaggctctgtgaggtccctactctcatggggtgcatggtcccctctgtgctcactcacctttctcctggaggggcctcatcctgcccttttgctggctcgagaaactcagataaagagttcacaaccctgatatggaacagaagggtatgaggggacccacatctggccacatgtgcctaggtccactgggagagacagcaagagatatccaaattcactggacaccatgtgtcctgggcaaggagcctgctgggtcctcatgttgactcctggcagagtctggggctctccctctactgacctgagttcagccccctaagaccaaggcatccccctccctgacactgatgatcccaggataagagagagacctcagctgacagccctgcctatgctctctggggtgacatcaggggcagggaagatttctgtggagcccccgtttgcgttcttgcctgggggtaccctcagtcctccctcaggttcctcacctggacacctggcagatcctgggaccagtgtgtcagtcgatcagactggggtccctgtgttgacctgagtcaccctctgaaaacaaggtcctcacctccctaagatctagaaacagaagtgaggaggcgccacatcccatcaccattgggtggggtgtccagggctcactccaggagctggcccctttggttctggggtgaggcttccaatgtcttccggtgggttattcatctttactcctcctggcgcctgcccttcctcaactcccaaactcctgagaggagcagccatctcgcctttacaccaacaccccatgtccccaagggttccccaacttcctatctgtggtacaagtgagattgccaattagggacattcctgatctgattgtcccagagctaagaataagtgacagccataatctgtggagtcctttccttctgggccaggggtaccatcagtcctcatgaagggggcactccttgggtcctgctgatcctgggacccctccctctgctggccagatgtggcttcctctgttgaactgtaagtaccactaataccaaggtgttcacctccctgagacctcccacctcccgccatatggcagaaaggagagcatgccacatggtacctatgcctggggccacccggggctgagaacagtggaagccaggttctgcgagttcccttcttcttggaggtgtggaggtaccttcttaccttcagtcttcaccaaccttccttctcttgacgcctggaagactggacccaacctgtgctgaccaggtgtggctatctctgctgagctgaggacacccctcagacggaggcccccacctctctggggcctgggaggcagaagtgaaggaactctacactgacacccctcaatgggattcccaagactgacaaaaggtgcatatttcaggagtgcctcctgtgtctgggtgtcctatagatattcagatttacttccgacagggcctggccctttccctcctgctgaactttggacggtcttccaggtcaaggccaccatctccctgggatccctaacgaggaagtgggggccaggtccgttccccacagtcctgcccgaggccccccaggactgacaggaagggcaggtgtcctacctctgggaaagaagctctgctgagtcttccctcagggtcctgagactcctccctctgctaacctgagcctccactcctcataccaaagccctctcctctttgttgtctccaaggcataggcagggatgcaccacatgcagccatcgtgcgtgggacctccaagggcggaggtccccagtgatctggagtccaaggtgtcctgagtcctccctctttttcctccccttgatcctggcagggctgcgtcagagctcccctctgccgacctgagtctatctgttggattcctgaggcgaaatgaggaggtgccttagcttgagatgggggcggggcgggtcccctgtcctgtagtgattgtcctttaaggcctccgtgctctcccggcaggacctgggccctccgtctactcctctgaggtgatgctcatggtatcaagccccttccctccatcagcccaggatgtggacagcagcatcaacgtgcctggtccccattcccagcatttcccagcgctgacagcaaagacagagcttccttctatggggcctcagccctccctcagaatcctgaccttgttatgcctggcagagcctggcccctgccctctcctaaccagccctgccctggtcataccaagctctgactccagagtcccctggggcttaagcggtggggtggcgaagggtggcccacagcctgagaagtccgcccccaggtggtccagggctggcagcaggggtggtgctggattatttggggtcttccctctggggcgggggcgtcctcagtcctccctcagggcctcaccttgcctcctcacggaagctgggcccgcttccctccaacaatctcatcagaaccaggccctcacttctctgtgatccccaaggcgctcagcacaagtgaccccattctggtcaggtgtggtcagctggggcttagggcaggaggctagtccacagcagtggcctcccctgaatgttgtttcacacaggcccccgagttaatgagcctttctaaaggagacagtgttagctttgcttaacaccgagctttcctcccttgctgtagacagggatacttggatgctcgtgatttccactggttttcttttctacagaatcttaaaagccttctgtacgaaactttgtctgtgaggaattacagtattaacactattctcaatcagtgtatatctagtgcttggattggctttcacgctctttctctctaactctgcgtgtgtgttcgcgttaagcttttcaagtatgggaaacagaaagtgtttctgaaggtgataattcttgcctcctgggatccctggagaaaggaagtccacatggaaaaagagagacggtctccaggtggagatacatcttcagagattttaaaaacagttttcagcttgtgttctataaatgaaccaaagatgacctgtgtgtgtagcccctaggctggaggaaggccttgcttattgtttagacgtgggatgtggctggcaaagggccttgcagtagcatctcagctgtcgtgcagcactgctgatgtttctctactgtttttcttcacaagactgagacctgttggctcagaagcccatcagcacaaaactgaatgtttcacacagttgatggtttgaaacgtggcacagctaagtacgtttttaggcattcagagccttcctcgcttgcataccctgctagtcctcacctaacatctgctaaccgtagataagatagaaccttatggttacgagactcccaagccacttggcccagctgctgagcaacatcacctatactcataaggtccttctccaattcccatctgcaccatcagttctcctgccttccttccgttctgatggtgaccctggaaacatagactctggacagtctgtcccctccctgcattccctgtccaagcaccacccaataaagctgcttgtatggtacagcctctggtgatcctctcattttccttgatcaacccccagtcccaaacagtgtgaaatgagctcttctgaactgggatgtcagccacgtataagctgatgactgtcggagctaaggtgcgtgatttgaggtgcatgtttggactgtaagactggcaaggcctaaaggccataggaaagcatgccaggcaggcgtctccctgcctcactgttttccggccttgcagcgtgctggctatcctgctgctacagaaccccttccttccacccccgactgttttggaattgcaaagtcacaaatctcaataagctggccttgactctaaactaaaaccaaagtatctgctctgagctgtttcggactcaccacaagctgtgccaagcagaaagcaggcatagctcaatgcaacaaaggcatctttgactctggaaccctggcaggttttaaacacctgttagtggggttcgaaaccatcaccacacagcacagatgcagcacagacctcccacatctcttgcagatgcccatgatgaagggcttgttctccggtggggccaactggagtgaagctgctcatgggcactgtatttctgatgcagacaggttgcacttctaacttgtgcgatgtctgctgaaagctgcatgttgtgggatggcaccccccatcgactgtgatttctccacccacgcgtgacagatcagtctcagatcttctctctagcgtgtccactgccagtcatttgtgtcccaggacccacttcagttgcagtttttgatagtggacagacagcctaactctgcttcctctccttcctcctggtccacacgccaggcagtaggattatcaaatgcagctgagcccaggaagggatggattttgttttctttttatcattattgttctatactgtttactgcataaatgagcaggatgaaaaggggtatgcaaactcattttggaatcttttggaaacataggattttttcctggctgcttcctaaacatgatgggtctttctgttcacatcttgttttatgacagtgttttactgtgaaaatggttttgtccccatgacacacagccctgccaggtgagaaggcctcaggcataaggggatgattgaaacaatgtaaagcttttattattgagtgggccatgctgatttagtaaggacggaggaaaaacacaacatctggggaggtgtgaggagggcattgtgatcctggtgttgcagaactgttcctggaagctttcttctcttgctgaaagaaaactccccatactgcctttgcaagcagctgcaatttccgtgaccccaaactgatggctgcacccatgacaacatctgacctcgctgactaggggacagagggagagaccccggctccactgttttccccacggagtaccttcagatgccctccctaccagtcatggagaagccaaattgtctgcaagtgaaaccagggactgaactggattatgtgtcctgtactggatacccttgtagctggcaggaggtgccatggtgatatatcacagtgaggccttgatattctgtgcttcctgactcagttcggccaccttggggtgcccaaattatggtaccgtgtgtctttgcagggggaccacatgtgccctcggggttgtaagtcccatgtgtgccctgcctttgtgacatggcctcagtccaggatggctttcaggtcaggtcacaacggtccagagctgtgtcctgcctgaattgatgccccaattgattcaattggccaagtataaagaaaaagttaatactgaaatttaagagggaagccacgtggctgtctaagatgcacctctgtggttaatggggttcgtgttaactggttcagtccaggacccctaacggcgtatgtgacatctatatgcagctcggtttcgccctgctgtgtcaggtcctactgataatttcctgtaaagacgccttgtctaaaagggtgcgtggttcagaaaaggagcactgggcaaagaaaccagaagttgaagtaaggtcaatatggtggagaaattcctgtgctatttctccctcttgtatctccaagcatggactcaaaggcagcctacatttgagaattgcacaaggataggaaaagctgtatgtatgaaggtctctctttatggtccaaaagctaagaaggcaggcccatagaggacatgggtaatgagggaaaaaaatctttcgatcctgctggacctgcctccacaccagccccagtcctgcatctataacctgcggttgcagcatcaaccacagctgggcaggcaggcacctaaaaccctcgaataggtgattcctgctctctgacaagaaatttcaaccaaaaagtagggggagagtttgggggtaagaaatgaaaagcactcgtgcaggtcatagcacagtggcagaggccaataaaaagactgagccctgctcataggtgtgcagaacactttccctcccccacgccttaccacgatgtcagtaggctcctgtgtaatagcaggggagcagcactgaaacaagtgcacatcgcaaacttcatttaagaagagtcccatgccaggcacaatggctcccacctgtaatcacagcattttcggttgacaaggcgggagggtgacttgaggccaggagtttgagaccagccgaggcaacatagagcgacactgtgtctaaaagaaacaaaccaaatagaagaagaaaaagtctctagggaaatccaagacaggagggaagaacaaaacaaggacacctgagtaaagtttaacctctgacacctatagctccagcaaacagtaaacacagtctaccgcatagtcagataaaaataaactctcagctgaaaggcccattctcttccattccatttactcaggacattactactggctttcaccaaaaatgttacaaggcatagtgaagggggaaaaaaaaatcacaggttgaagagtaaatatcaggtacatatgcaggtttagcagagatgttagaattaccagcttgagaattaatacaactatgatgaataagctaagggctctaatggaaaaagtgaacaacatgcaagaacaggtgggtaataatagcagggagatggaaactctttaagaagaatcacaagaaaacactaaaaatctaaaacactctaggcaataaaagaacacaggcaaattagacttcatgaaaattaagaacttttgtgcatcaaaaacacaatgaacagagtcaaaatgcaaccaaaagactgggagaaaatatttgtaaatcacatatctgttaagggatatatatccaggatatataaagaactcctgaaacatgacaaaaacaacaacgacagcaaaatcaaaaatggggaaaatatttgaatagacatttctcctaaaaatatacacaagtgactgatgcgcatgagaaaagatactcaacatcactaatcattagggaaataggaatcaaaggcacgatgaggcacctcctcccactcactaggatggctactgttaaaacaaataaagcaacgaccaaccaggaaataacaagttggcaacgatgtggtgttagtggaatctctgtgtaggttggaatataaaatgttacaaaattgccgtgggtaacagtatgtgattcctcacaaaattccaaatagggttaccatattatctagcaattccccttccgaatgtatacccagaataattaaaagcagagtctcaaagagatatttgtagacccatatatatagcagcaatgttcaccatagctaaactgtgaaaccagcctaagtgtcccttgacacataattggattaggaaaatgcaatatacatacaatgggaaattattcagcattcaaaaggaaggaaattctggcataaggtacagcgtgactgaacctgaggacattatgctaagtgaagtaagtcaggcatgaaaagacaaatactgtaggatatcatttacacacggtacatagagttgtcaaattcatagagacaggaaatagaaagctagttaccagatgagagggaggaaaaatggggagttattgttgaacgggtatagtgtttcatttttgtcagaggaaaagagttcttcagatgagccatggtgatggttgaataagagtatggatgtatttaagagccctgaaatgtgcacttaccatggttaggagggtttatgtgataggtgttttatcatgatagaaataatttattaggaaaaataaaacaacccccactgtaacagaaatgaaggatatctttgattaattcatcaataggcaggacatggctgaggtaacaagcagcaagcctgaagaaacgtcaatcaaaaatccaaacctgaaatgcaaagagagaaaaaaggaagaaaagtaacagaaaattcaagaagcatgagacagttacaaaaggcaccaccactgtgcataactgaaacaccatgttcagaaggtgagaaagaaacaaaggaaatatttgaagtggtaatggctgagaattccccgaattaatgacagacatgaaactgcagattcaggaagctcatagaacaggaaacaggataaatactaagaagtatacatctatgtacatattcaaactgcagaaaatcaaagagaaaaaaaatcttgaaagaagctggaggaaaaacaagtgtgagagaaatcctttctctgtctatcctctcaacacttggccgcctagcgtgacccctgaaagggaaatgcacagcaatgtgaggacacaaaagacttaccttctagctagaggatcagagaaagtccccagggacccagtgagcttgggaaaaaccactgagagtagcgaatgtaagcaagagaacacattaaattgagcagaaattcctgggctcaacctaaggtgctcacgcagaaatcttcatagttaccgaggactggaggactgaactagtggtagaccatcacccagtagtcagccattattcaggaggactcagaaatgctatggatgcaaatatcacagcaccaccaacataagaatatgccttttttcaagcacacatggaaaacacaccaagctagattatctcttgggtcataaaataaatatatttttttttcctaagacagagtcttgctccattgcccaggctggagtacagtagtgagatctcagcttactacagcctctgcctcccatgttcaagggattctcctgcctcagccacccgagtagctgggattacagacacacaccaccatgcttggctaatttttttttttttagacagaatctcgctctgtcaccaggctggagtgcactggcgtgatctcggctcactgcaacctccgcctcccaggttcaagtgattctcctgcctcagcctcccaagtagctgggactacaggcgcacatcaccacgcccagctaatttttttttttttttgtatttttagtagagatggggtttcaccatgttggccaggatggtcttgatctcctgacctcgtgatctgcccgtctcggcctcccaaaatgctgggattacaggtgtgagccaccacgcctggccggctaattgttttatttttagtagagacagggtttcaccatgttggtcaggctgctctggaactcttgacctcaagtgatctctctgccttggtctcccaaagtgctgggattacaggtgtgagccaccttgccagtctctctttctttctttctttctttctttcatttttcaaacaacagatttttaaaaatccacatcatcaagcttatgttcttcgacctctatggcaccatattagaaatgaaacaataacataagtacaataggaaattatcataccttgtggaattaaacgacaccatcttcaacaattcaaggatcaaaaaggtagcctcaaggaaattaaaaagtccatagaactgaatttaattggaaaagcaacatatcacaacttgtgggatgcagctaaaacagtgtttagagagaaaattataacattacttagattaagataaaagaaagatctcacataaataatgtgagcttctaccttaactaaccagaaaaagagggaaaccaattaattcaaagcaagcagaaaaaaagaaaaaaacacaacagaaatagttcacaatgaaatccgaaaaaaaaaaaaaaggaaagaaagaaaaatcatggaaaccaaaagctgttctttgaaaggatcaagaaaatggatggaactctagtcagtcatggaaagtaagagagaagatacaaattattaagatcaaaagtgaaacaggaaatatcattagagaacctgtagacctgaagatagccatgaaatgctaagaagaaatctgtgcagaataattcaataactgaaatggaattcatgataaaatgaaatgaaattctaccaaaatcagaaactagtggaactcaccttagacaaaatggataacttgaagagtactttagctaccaaaataactgatttcatagtaaaactctttctgagaaagaaatctgtagacccagataggttcactggagatttcgtacaaccatttaaagaagtaacatgaatttgcacagtctctcagagaaaatagaagagaaggggatgtttcccaaatcattttacctggttaacattaccatggtattaccaggctaacagtacaaacaaacaaggaaacacaaaccaataaaaattctagaggtcaatatgcttcacaaacatagatgcaaaatctccaaaaaattagcaaatagaatccagcaatatcttaaaagtcggatttatctggagaatgcaaggctggtttaatatttgatagttgatcaatgctgtccactatatccagaaatgtatgatgacctcaactaaagcagacaaaagcacttgagaatgtacaacataatcacagtgaaaagtctcaggaaactagaaatagaaaggaacttaacctgacagagtacatgtacagaaaaccaagagcaaatatcaaactgggtagtgaaagactgaatgcctacccctaaaaagagaaacaagaaaaggatgtcccctctcaccactcctattcagaaaggtagtgggattcttaccagtgaaatcaatcaagaaatataaataagagacatcttgaatgggacagaatatataatgttgtttccaacctcagaagacacaactgcctatgcagaaaataccaaggaaactgcacaaaaactcctcaaataagtgagtgcaggcaggtcgcaaggtagaagctcaacacacgataatcgtattatcgtacttcatataatggcaataaaaatgggaagttgctgttgcatttccttaggctctctgattgtacctttcaccctgtccagtcccctgatgagaccaacaaaggcattcttcatttcccttatggtctatatatttttttaatttttagcatttccttttcatttattcattcattctttttttaatttttagcatttccttttcattcattcatttttttttttttgagaaggagtctcgctctgttgcccaggctggagtgcagtggcacaatcttggttcactgcaacatctgcctcccaggctcaagcgatccttgtgcctcagcctcccgagaagctgggattacaggcgcctgccaccacacctggctaatttttgtattgtactcatttatttatttattttttaagtagagacggggtttcaccacgttgaccaggctggtctcaaactcctgatgtcaagtgatccatccaccttggcttcccaaagccctgggattacaggccccttttcagttgttcttgaagagtttccatattttgacttacagtacttacctattcttggatattatccactttttccattagggcccacagcgtgttactcatacttgtcttaaattcccagtcagatcattccaacatctctatcatatctgagtctgtttctgatacctgctctttgtcttcacactgtgtgtgtgtgtgtttttttttttttttgtctattagtatgctttgaaatttccttttgcaaacttgccacgatgtgtcagatgaaaagaatggagttaaataggcctttagtgtgaggtttaccttcatctggctgtgtttactgtttgctgtagctgtaggtgtcagaggctaaacctccctgtggtgtccttcacttttcctccttggctgtgtttggttttccttggagacctgctcactatggtctggcactcacagttctttcagtttcattccccagttgatgtggcagtgagctgcagagggaggggaagacttctatcctcctatgactacatggcaggcttgagtcagtgtacaccgggctgtggctttcactagtgcttctcagttttgttttgttttctccttggacagacattaaggggccagaatgttgtagctgggtgttttccttacccagtgttgatgagagtctagaaaaaaaccaagtaggacagactctggtaaaacagtttctcttgagggcagaccctcgtttgaagaacagaatactctgggcatattttcgaatgactcctttctccctctggtcctcactgggggaacctgatagggctcccagaggtgaaactctggaaactgtggtagccttctggatggtgcccccaggagtttttagttctcaaatttgtccatagtgagccctccaccattcgtcttataaagatgaggttttcgtatcctggtccttgtttctgggcattcagctcctgagcttctgctctccaaagttgtggctgactgtatctactgtctcttccgttttgggtcagcaatcagccctatggcctcagctctctgagggatcagagaaaagttgttgttttccaatttgttcagcttcttatcttgtttgcgtcagaggcagagagccatctagctccttacatacccgagtgaacataagaatttaagaaaattggaaaacttttttaaacatagcagttttacataggtatacatgtggcatggtggtttgctgcacccatcaacctgtcatctacattaggtatttctcctaatgctatccctcctctagccccccaccccctgacaggccccagtgtatgatgctcccctccctgtgtccatgtgttctcatggtttaactcccacttatgagtgagaacatgcggtgttcggatttctgttcttgtgttagtttgctgagaatgatggtttccagcttcatccatgtccctacaaaggacgtgaactcatccttttttatggctgcatagtattccatggtgtatatgtgccacattttctttatccagtctatcattgttggacatttgggttggtaccaagtctttgctattgtgaatagtgccgcatggcacgtggatacctatgtaacaaacctgcacgttctgtactatgtaacaaacctgcaggttctgcacatataccccagaacttaaaatgtaataatagtaatttaaaattaaaagagattccctggaaaaaaaatcccatctcaatcactttgctcttttagtatcacttcttgtgtgccctttcctcctttccaaataatcatttgaggcccagctgatacagcatattatcctcaaaggctttgttgactccagctacactgtagattctgtactatacattcttgattttttttaccaaaaaaaaacccaaaaaacaaaaacaaaaacaaaatagccattttaataaaattaaaaatgaaatgctttggtatatatctaacaaaacatgtacatatcaggatggtgaaaactacaaaatgctgatgaaaaattcaaagaaggcccaactaaatagacatagcatgtacattcactggaagactcagtgaagatatgtgatctgtaacaaagcgatccatagatccaatgtaactccagtaaaataccagcaagcttttttgtacttgtacacaagctgattcaaaaagcatacggaaaggtaaaggttttgaaataattaaaacaattttcaaaacacagagtaattgcacaaatcgtaccactcaattttaagatttagcataagcctaaaacaatcaagtcattatggaattttctaagggatacacgtatagattaatggattaaaacagagaatccataaatagatccacgcgaatatagcaatggaggttttagaaaggggtaaagacaatttattggaaaaatattagtcttttcaattagtggtattggaacaactgaacatccatgtgttataaaaaagacttgaccaaaacctcacatgttatacaaaaattaactcaaagtggattacagatccaaatgttacatgaaatactataaaacttttaaagaaggccgggtgcagtggctcacgcctgtaatcccagcactttgggaggccgaggtgggcagatcacgaggtcaggagttcaagaccagcctggccaacatggtgaaaccccatctctagtaaaaatataaaaattagctgggcgtggtggtgcgcacctgcaatcccagctactcgggaggctgaagcaggagaatcgcttgaacccgggaggcggaggttgcagtgagccgagatcctgccattgcactccagcctgggcaatagagtgagactccgtctcaaaaaacaaacaaacaaacaaacaaacaaacaacaacagcaagaaaaaacttaaagaaaacacagggtgaaatattagtagcctgatgtgaggcaaagaggtcttaaacatgacaccagcagtgtgattcataaagaaaagaaacaataaattagacttcctcagagttaaaacttttgctctgagaaagacactgaagagacactaaaaagccaaacgaagtattcacaagtatttgcaaatcatatatacaccaaaggccttttatgaaaattgtataaagattcccaaaatctcaaaacttagaacacatgtcaaaacacaaagtttcaccaaattttgttcaaagatctaactggcttttctttatgattcttgaatgggcattttttctctccgtcaacttgaatgcgtgtccctatgtgctgagcaaaagacgttggcttataggcagaagaggacgaaaaaagtagaaacagggaacaaaaggtggtttggtgatttcaaagttgatttccttgtaggattaaagcagagaaaactttcttatcgtgcctgctcaggtacggtgggctcctcgttattggttgctgtgactattctgtttttagttttttgagaactggcccgtttcaatgttcactttgatgaatggcaattagtacaagggacactattctgattttgtctgttctgctggggtctggggccagagattagggcaaaacaatggcctcccatgagttcatttaacacaaacaaccacattttttagaagggcaaaacatatcaatagacatttcacccaaaaggacatacgcatgacaaataagcccatgaaaaactattctacatcacagctattagagaaatgcaaattaaaccatgatcagatgccataacacatatttgaaaatgactgaaatttttaacgagatacttgtaagtgctaacaaggatgaagaacaacttgaaatttcatacattgctagtggcagttatgaaacgggacaactgcagaaaatgatttggtaattacttatgaacacatgccatgtgactcagcgatttcatctaagggaaaaagaaaaatttatgttcacacaaaagcctatgtacgtgaatgtttatagcagctccagtcatatttgccaaaacctggaaattatacaaatgtatttccatgggtaaatgggaaatgaaattttggggcatccttacttactatgaaatacttctcagcaatgaaaaagaatgaactactgatacacacaacaatgtgtttcaaactcgaaggtgttttgctgtgtgaaaggagccagtctcaaccagttacatattctattattctgtttacctggcattcttgaaagagaaaactgaaacgatggagtacagatgagtggctgtcagggttcggcgcgcagtggtgggtacagctataaatgaattgcacatggagggggtttcttttggggagaagacgtaataatcttaactattaattcacctaaaagcagagcttcaaaatgcaagaaactacatctgatagaactgcaaggataaatcgccaaatctacaatgatatttggagatggcaacagtcctctccaagtaaatgattgaagtagacagaaattctgcaagggtgtaggaggagctgaacaacaaagaacaaatgtgagctgattagattttagtgagcactcctcagaacgacggtagattatatggtattttcaagtgtgtgtggaatttttaccaaaagagaccagaaaacaacccataaaaaatttaaaataattggaattgtacaaagtatctttttaaaatctataatggaatgtaattcaaaatataacaaaggaaatatctgtaaagtccttaagtatttttaaaataaacaacacatttttactaatccatgtttaaaaaaattcttgaggaaggttagaaaatattttcaaataaataaaaatggaaatgtgatgttttaaaatatctgcaatttagctaaaatgtgcctaggggacattttatgtactgaaatgtttatattagaaagtaataaaagactcaaatatgtatattttgatctcaaatagctagaaaaggaaaaggaaattaaacctaaggtgagcaaaacgatggggataatatagacaagaagagaaaaattaatgaaattgagatttcagaagttttagaaaaacaataaataatactgatggaatcaaaagttagatctttaagtagatcagacaagccgaaaggcccgaagtcaatctaagaaatttaaaacacatgggtttgggccaggtgcagtggttcaagcctgtaatcccagtacttcttgaggcagaagcaggcagatccgttgaggccaggagttcaagaccagcctggccaagatggtgaaaccctgtctctactaaaaatacaaaaattagccaggcgtgcggtgcatgcctctaataccagctattcgggagactgaggtacgaaaatggcttgagcctgggaggcagggattgcagtgagctgtgatcttgccactgcactccagcttgggcaacagagtgagtctctgtctcacaaaacaaagccaaaccccagaaaacgtggttttggagaagcaacagcgttgaacacagctagaagtagaggacactttacagaaactattaactgttgtgacaacaacaatgtttcttagagaagtttctgagaagaccagatttgccttgaaatgctcgacgtgtctgctatgttacagatgctttcaaacgtattaacccaggggtccccaacacccccggccatggataggaactgggctgcacagcaggaagtgagtggttgggcaagcaggtgaagctgaactccacctcctgtcacgtcagtggcgacattagattctcataggagcgggaaccctattgtgaactgcacacgtgaggggtctaggttttgtgttcctgatgagaatctaacgcttgatgatctgttactgtctcccatcacccccagatgggaccatctatttgcaggaaaacaagctcagggctcccactgattctgcacgacggtgagtatgcaataataatagaaataaagtgcgcaataaatgtaatgtgcttgaatcatcttgaaacaatgccccacccccaccccgtgctcatggaaaaattgtcttccagaaaccggtccctggtgccaggaagggtggggatcactgcattaacccatctgatttgaagaggatcctgtaaggtcagcatggagagttcaccttgtacactccatagcattttctgcacttccctttgccacaccatctatcagctcaggaagctgaggatttcctccttccatctgatgcaggggcagaatcttacccatcatctctgctaccctccatatgactgttcttacctgaacacctgtataggtgccactagtcacgctgaaagccggcatgttcctggggacagatgccagacaggaagcagtgaaaggctggttaaatattcttttgaaactccagctggcatgttcgccatggaaccatttttcccctcctgggaggagcccagggtttgtaagaattcagcttcatgaaatggctgctcctcttctacctcttaggaggggaatttctgagcaccatccgtctgtttgcgtgttctgtccccagcttcagataacaaactcaataaaatcctactacaaatatgcaactgactgcgaaaatactctctcaatcctgggggctgcaacccaaccaggagcttatgggtcaaattggactcttctcacagcccactgggaatacacagagtagaattctcccagggagggaggaccaagtgtctaaagtcaccgtccagaatggttgcggctgtgggactggactaagggcgagccgtgcgagaaccaggggactacttcaagggctaggaatgctccatgttgcaggaagggcaggggggtctgcccagcctccagggggaggcaacagtgaagagcaagcagcaggtcaggtcgcagagtcagaagggaggaaacatgatagtgaccggggaagggcactgtgacacgggaacgtgctgatgccagacagaagtgctgattatgtattcgtcccttgtgcccaggaaagagaagatcaaagatgtggatgagcatttgtaggcgctcctacaacctgttgcatagtaggtgctcaacaggcagcacccagcagacagttcccaggggacccccggcatgccatccccaaattgtatttgatgctcattggcaccttctttaggcctgcatttagtaccttggcctcagggtccttctttttgttgcctgagagacatgatgcattgctgagaagaggaatgaagtgccagtgaggaggtctgcctccggctcaggggagtgggaacagcacgggctctagaggaattcagatcagggatccggttccagctctgttccttactagccacctgatcctgggaaatacccaagttctgtgagcctctggttcttcatctgtgaagcaggtatgatgaggcccttccactaggacggttagagtgcgtgcaatgtaagtgaagcatctggctcagggcctggcattaagttagaagtttaaggaatggcggatggctgtcatatctaatactatttgaccctagaccctagcactctgggatttcgtaaatgttgttgttctccaagacttaccagagaatatacagctcagtaggacatgggataatcagccccaacaggaagtttcgtcaataaaattaagtatttcctcttagcgaacgtgcttcaaaatttgggtgtgctggagtcttgcgcagctgaatgcagctcaaagctcctagaatttgaatcgaggatcaactcctttcctctctcccacctgcttttggatccgagactctgttttcacttattttgttaacactcgaaatctagcctttgctcacaattggtcaaatcccacctgagataacttgattagaatgccttttaaatacgatcaactctggctctcccagacaggcagaaaagcacctggccaatgacttctgggcttcccttctgggagattcaccctcatcttgcaggaaacccttgcagatgataggtatccatcacctagcccctgcactgtgttcaagcgcaccgagacaagagcgcgggacgatttccttctattcctgccccaggtggagactcttctctgttcatccactatccaaaaggaactgctgagcagtcgtccattccaggcctttctctcatcctctgagaatctggctctggcaccacccagcttcaatagaattacctcccccagaaggaactgcagtttcccaaagcccaaagggccctggctcagggcatatacactcgactgctgtcatctagagccccaaaccctcacccatgttttattttcctctacttcttagaggacatggcaccaccttaattttaggattgtagcccctagacttcaccaccctatggcaaaggggtgggtctggcttaccgagcatctctactactaacccagggtgttccgaataacagatgttcagtgcgtgtctgaagaaaaaatgagccagtgaacaggaaaaattattctttcaatttttatttctcttacatgctcaaagaagccaagcaaatccaggtatacatgtatatgttttaattttacaggagagagaaagaggtataaggcaagaattaactacattttcatttcactatttctttatgagctctattttgctgctaagttcaagtttcaaaaaaattattaattcctctgctatgttatcttgtcccaattcacaaaataacagggatttccccatgtgactcaaaagcaagaatcttactcctaaataacataaacagcaatatgtgtgactactgtcattcattaacttcgatggtgaagttcattaaactgaccattaaaagaacatttgaacaattccaaaagggagcaaggataaatctccaaatcacccaatagacaaggaacccagagatgacatacagtgtgctcacttccacccactgccactgagaacactgattgctctcttcaaacacagagcgaagaatgggcctcatgtcacatggggcagggcagctgctggatggggccctgaccccacaaactttggccccggctgcggctggtgctcagactccctcttgctcctctcccaaaacctcttcataaagggatgggtagcagatgggctctcttgcattgagcatgaccaaataatttatgaccttctcatagctggtttcagcgtgggccttggaaccccacaggaactcgtagtgcgcaggatcactgccgggcacctgccggtactccaggtagttttcctgcacccaatcttgggtgagcagcttcctgggctccccgtagaacatgtgctccttcccaacatacacccccatcacactcaacgcttcccagataacctcttcaggggcgcagttgtctttggttaggatcacacccaggacaatgatcaggagggcggccttgggcatgctatgaccatcacccagcatgctatcgcacgagaggccaagagcagtgacaaggatgtaggagtggccggcggggtccacctccttcacatcagtgccaaagatcacctgcatgaactcggaggctttgccgaagatcacaggaaagtagcgcttgtaatttttgatgacgctctccagcatttctgcctttgtgaccggctccttgactcgatatttgtggagcaggaaatgaaccaactcagccaccttcaatttcagtgcttcttggaacatgaactccagctgagctgggtcgaccgaggagcttggctcttcctcttcttgactgctggagccctcatcgaattggctccataaagtgtagtagacggaaatggaggaggaagcgcctccctgaggactctggggaggacttgatgacccagcagcagacacctcctcctccttgctgtcagaggaggaggtagtctcctcctcctcgcctgtgggttcctgtgcacccatcaggcccaagtcctctccttgggcttcaaggtcttcatcaggcttgcagtgcggactcctctgctcgagagacatgatgactctggtcagggcagcagtcaggagcgtgggcaggagctgggcgatggagacccacaggcctggggagagagggagcgtgtgagagacttcagctgagaaccgaaccttggaggttctaacaaaggctgacttacaggtcttcgtcagtgctgctctggggcctcttggggctcctgtcctcctggttagcctgtcccgagaacctgagggaggaagtgagagggctactcagcgtgcagctagcctgcagagatcaaggctctatgagtgacagtagggggaatggggccaggtgctatggggtcccatgtgtgctggggcaggtggggcccttggtgcacattcagggtgaacacttcaccttcactgctgacactgcctgggtctcctctgctctgcgacctgaggacactgtctcagaccaaggcctgcctgcttcctggagctcctggaagaggaatcgaggggcccttaggctgcagactgcaggcagagccccggtccctcagtgctgtcaagagggcgggctggacactcttgagttctacacacttttggggtggatggtcccctctgcgctcactcagggccctgacctttctcctggcagggactggactctactcctctacttgcctgagagtctctcagatcaggagctcacatccctgatatggaacagaaggacatgccccaaccaacatctgcccacacctgcccagggtttcctcggaagtacagtaagagatgtctaaattcaatggggtccatgtgtcctggggtgaggatactgcctggtcctcatcttgatgcctgcagggtctggaaccctccctctgttgacctgaggccctatctccaggagacacctgaagaggaagtgaggggagtccatccacccagcggcttccctcagctgacacaaggggcagggtggggctaggtcctctgtgtttggtgagtggggtcccctcagtctgcacctggactcctggcagggcctgggaccctccctctgctgacgtgagtgcagccccctcagaccaaggccagccctccccgacaccagtgatcccaggataaaggagggacctcagcagacagccctgcccgggctctctggggtgacagtaggggcagggcaaactctcttgatctgagagtttctctggcctggaggtaccctcgatcctcccttaggttcctcacctggactgctctccaatcctgggaccactgtgtctgtcgaacacagggcctccctgttttgtccacacacaccctctgagaacaaagtcctcacctccctgagatccagaaacagaggtgaggaggccccacatatgtcacccctgcgtggggtgtccggggctgaccccaccagctgaacccttcaggtatgaggtgggtgttccaaagtcctcctgcgggttattcatctttactcctgctggggcttctacttcctcgaccctcaaacccttgagatgagcagacatctccctttacaccaacgcctcatccccctgagggttcctcaacttcctgccgtggtacaaatgagcttgccacttagcaccatccttgatcaggcccccccccgcccccagatctaagaacagagttcacctagactctgtggggtggcttctttctgcgttgggggtacctccattcctcatgaagggggcacaccttgggtcctgctgatcctgggagtcctccttctactgaccaggtgtggagccctctgttggatctctcagtgccccctgggatcaaggtactcacctccctgagacctctcacccccagtcacgtgggagaaatgagagcatgcctcatgccattcctgcctggggccacctggggctgagaacaggtgacaccagtgtctgtgaggtcctttcttttttgagagcgtggaggtaccttcttaccttcagtcctcaccaaacttcctccccgtcactcctggaagaccctggattccaccctgtgctgaccaggtgtggctccctctgctgagctgaggaaacccctcggaccaaggcccccacctcccggagacccgggaggcagaagtgaggggccacctcatggtcactcatgcatgagatacccaaggctgaccaaaggagcaggttccagggggcctcgtcggtctgggtgtcctctaggtattcatatttgcttctgacagaatctggccccttccattttgctgaaccagaggtgagtcttgcagaccaaggccaatttctcccttagaccctctttgagaaagtgtgtgttgggggtggagggggcacttcccttcctcaccgtcctgcctggggccttccaagactgacggcaggggcaggtttcctaggtctgggatgagaggtctggtgaatccttcctcaggcctctgggactcctccttctgctcacctgaggccccactcctcataccacagccctgttcccattgacacccgatcccaccagccacaatgcaccacatgcggccaccgtgcccgggatcgcccaggccaagatccccactgagctggactccggggtcccctctgtcctccgtcttgttccttccctggtctcctagagggctgggccccacccctctgtggacctgagtctctatctgtcggattcccgaggctgaatgaggaggggcctcggtctcagataggggcggggtgggccccttgtcctggggtactgggtcccctcaggcctcccttgtctcccagcaggacctgggccctccctctgttctcccgcggccacgctaacgataccaagccccttccctcggtcagcccaggatgcagatatcacgatccgcttgcctgaccgccatgcccggaacttcccagggtccactgcaggggcagtgactccctctatggggcctcagccctccctcagggtcctggccctgatgcctggcagagcctggcccctgccctctcttaaccagtcctgccctggtcacaccaagctctgacccagagtcccctggggcttaagtggtggggtggcgaagggtggcccacagcctgagaagtccgcccccggggtggttcagggctggcagcaggggtgctgctggattatttggggccctctatctggggtgggggcgtcctcagtcctccctcagcgtctcatcttgcctcctcacagagcctgggcccgcttccctctgccgatcttcagccaccactcagaaccaagcccttgctactctctgacccccagtgcgcaagtcagaggccttacatccgggcacccggagcttccctgggttgacagcaggagccgaaccggattctgccacgggagacttgggggtggggtggagtggggggggggtgaggatggaggtggggaacctgaggctgtaggtcatggtggtggtggctgggttaggggtgtggaggcgttcagccctccctcagggttctgaccttgatgccagtcagagcctgggcccagcctgatacgcccgaccccgcggggtggtccagggctggcacaggggcggcgctgtattatttggggtcctctatctggggcggggggtcttgagtcctccctcagggtctcaccttgcctcctcacagagcctgggcccgcttccctccaccgatatcgacccgcccctcacagcgaggcccccgctactctctgacccccagtgtgggagtcactggccgtacatccgggcacctggggcttccctgggttgacaacaggggcggaaccagattctgccgcgggagagttgggggggtggggtggagtttggggtggggtggggtggggtggggtggggtgtagagtggagctgaggatggggctggggaacctggggctgtaggtcatggttgggttgggggggcccagcctccctcagggtcctggccttgatgcccggcagagcctgggccctgccctctcctaaccagccctgccctggtcacaccaagctctcactccagagtgcccagcagcttgagcggcggagggagggggtcggcccagcctcacaagtcagccccagatcggcccccgggtggtccagggctgggagcagagacggcacttggttctttcgggtcctctatctggggtggggacatcctcagtcttccctcagcacctcaccttgactcctcacagagcctcggccagcttacctccaccggtatcaagccgcccctcagaaggaggcctctcccttctctctgacccccagtgcgcacgtcagtgacgtcacatccggcccccaagcctggagcttccctgggttgccagtaggggctgaaccgggttctggcggagtaggggtggggatggggataggggccctcagtcatccctcagggggtcctgaccttgatgcctgggtctcgatccccattctctgcccattgggtctgctcctctcggaccaagtctctgactcccagtcacatgaggtggcagtgaggggaggggtgtggtcggggtgacaacattgccagggtcttccagggctgacaggaagggctgagctggattctgtggcccctctatgtggggaggttggaccttcagtcccctctcaggagggttctcctcctggctcctggctctttgatgaagtgatgtgtgggagatgatctgtttatgtcacctttgagcatttgcccagctgcacgcgttgcagagaatggctgcgggtcccaggctagatgctccctggggggctgcagcacctgtgattgtaggacctgtgagagaagatgcacaccatcccatgggggctcctccccagccagagctagactttgcaaaccttttgtcctaaaagatttatttttacacggaagaggctgagcagcagcaagagatttggagaagccatgtgttttgaaggtatcgaacacagcagagtccagattagcgattttcatattttaattctcattcacatggtaataaattttacactgtatgtgtacattatatatggtattgtacattttgtttatatctacgtttatatacatacctgttttagacattatatacatctatgcttatatgtatacatacacgcatatatatctttatatcttatatttacttacatgtatatatctttagctacatattcgtttgtatttctagactttatactatatatatgcacacatattttattaatatctactcatagtatgtggccttcacacatacttactattctattcctagttcattctttatattccattaaaataataattttttggaaggctggtcttctcctactaagtttgtttcaggtggttgttagcagaactctggagccatagtgtctcaatcaactcaaatttcctggtgtcctgatattactccagggctactggcatcagattttgtggtgctgcctcagattgcgcgatgatgtggggtggaatgttaaacactttctcctatccatcctgtaatctgccatctatgcagggtacagacctcctcgatttccctgctgctccctggacccaaaacacaagtactagtttagcacagtcttcagtcatccccagggctttctctgttttgatgggtttttttttttaatcttttccctcctatattttttccggggttgatttggggagcagagcacagcaacctgagcttggttgtcactttggcaatgacagttaaggcactcactctgtatttaatttaagtagcatttacatctttgccatattctgttccccatcaaggaatatggtatacagatccatttacttgagattatttcctgagtctatcagcaactttgcacagttgcttccataaaggtcttgtcaggctcttcttatttacattttggattttaatgctgctgtgaatggtgcattttctattttctattttatatactaagttgcttttgtgtggcaaggctcttgattttgctttaatgaccttctgtatgatgttttctgaagtcttttattcatttgaatattcaatgtgtctattcctttgaattttctatgtagataatcatatagttaacaaatactctatttctttgcagtcttcatatctcattttcatcttgacatccatagctctggctctttttcattttgatattcactgcagatgtaggtggtagtggtgacagcatatgtcaacgacttgtcactgccgtgaatggcagagcttctgacatttcacatttatgtatgcttgctgccaattttaggaaatggaagttccttttaatgttagtttgctaaacattgttaatttgtacttacatagaattcatttcagagccttttcctgtacccattgtcatgactgaatgtttttttctagtctatcttgtatgcagggagttagaattgaatttttttctaacatttaatcctatttttattccatgcatacaggcagcttgttcgtttaatccactgttgtgttggatatgtgattatctgtttatgacatttgctgcgatgtgtgtgaacacttgcctcacaaattcttttcatgagtgctcgggtgccttcatctgtttatgaatctaggagagcgagcctgggagaatgagttaaacaattgcccattttggatgcattggaagagttgagataagatggtgattcattttcccttgccacttggctgaactggcctccaaaatttcctgtcctggaatatttgagggtagattgaactttgaatacactttcagtttgtggaagtaccattggttttatccattcacctcttcaaggacatcttggttggtgattatgaataaactactaatacattcgtgtacacgattttccatgtgagaaccagtttccaattcacttaggtaaaacctagtagtacgactgatggatctaaaggtaagtctatgttttactacataagaaagggccaaaaggccttctagagtgaatgaaacatttttcttgtctaccagctatgaatgagaatcccacatcctctccagaatttgatattctcaggtatttgaattctatccattgtaataggtgggtagaggaatcttagtgctgttgacatttgcattattaatgaataattatggtgatcatcttttcatgtgtgtatcttcattggtgaatgtatgtgtatttctgcgtgtcttcattggtgaatgtcttcaaatcatttacatctttagttggattctttgttttcaaaggttgaatgttaaatgtttggtatttattcagcatatgagttctttatcagatatcagattactaatattttctctccatctatatagttttttccattcttctaacagtattttttttttttttttttttttttggagatggagtctcactctgtctcccagcctggagtgcagtggcgtgatctcgactcactgcaacctctgccccctgagttcaagcgattctcctgcctcagcctcccaagtagctgggattacaggtgcctgccaacgtgcccggctattttttgtatttttagtagagacaggatttcaccatcttggccaggctggtcttgaactcctgacctcgtgatccacctgcctcagtctcccaaagtgctgggatgacaggcgtcagccatcgtgcccagctgagattcacaggaaaaccacgatcggaggggtgtaagtttgtaggaaagaggtttttaagtggcagcatctttgcatgattcaaactctggaggcatatgcataaagtccaagaaacacatgagaaaactgtacttcttggaaactaaggagctcacaaatgatgaaatgtgattcacaccgatttgtaaatgagcacccatttgtaagtgagcaggccgagacagggagatccacctgcagaccatggctggactctggattaatccattcccatgtctgcattctcttatggcctcttcccacgtctcccaggactctgccacctactgtcaaattaaaaatcacaggcagggatacctctgggttctggtgtgtgggtgttggggctctctgcacgccctgatttcagagctcttttgatgtctgtgcccagttgtgtctacggtaagaacttgaatctatttcctctgatcagtcaaagaagttcgtcgatgatagcatgtgttctaagatgaacaccccaagtgagcagaaaaggctgcttcctaagttaaaacatgacatgacatcttttaaattaatttttgactccaaaagaaaggagaaggaaggaagggagggaaagagagagagagagagacacggaaggaaggaaggaaggaaggaaggaaggaaggaaggaaggaaggaaggaaggaagcaagcaagcacagagagagagagagatggaaggaaggaaggaaagaaggaagcaaagagagagagagagaaaaaaggagaggaaaggaaagtaggaaggaagggaaacaagaaagaaaaagtgggggcatagtgggggaatcaaggaaggaagtaaaaaaccccaccagatccagtacagacataaaagccaaacataaatcctgtccaccagacactaatgagcaccctctaaactgcaaacccgtaggactccttggtagtatgtgtcacctccacaactatcaagggcactttttaacccaatgacaaagccagacgtgatctcatctgtatgtaaagtgaagatcctgttatataaaggcaccgccatgacaaggaatggccagtaacacagagtcattgtgaaccctaggccggcaatgctagcagcacaattagcactcagcgagcaactccaggtaatttttttttttttttttttttagacggagtcctgctctgtcgcccaggctggagtgcagtggcgcgatctcggcttgctgcacgctccgcctcccgggttcatgccattctcctgcctcagcctcccgagtagctgggactacaggtgcccgccgccacgcccggctaattttttgtatttttagtacagacggggtttcaccgtgttagtcaggacagtctcgatctcccgagctcgtgatccacccgcctcggcctcccaaagtgctgggattacaggcatgagccactgcgcccggccagctccaggtaatttttaatgagtagaggcgggatgtctgaggggcttcctaaaacccagcacctgctcgagtatctcctgggcacttttccagggaggcgtgttaggctgaagtctctatcatgcaagccaaagatgtcggaggggggtactggactgcaaagaaagaaaaaggatggagaccatgaagacttttttgtgcagtcagaaaattactcattttctgacacatttattgaccagcacatattctgcccaaatgctgccctctatgtgctctggtctgcgtagtctgggtacgcctggggcccatcgctagctggcatgtactgtgacgtgcggtggctgtgggggcaatggtggtgcagagctgggagatgggggaacatgaccatggaggcagcaggctgtgcagccccagcagccactagggtcaccggtacccagagatggcaaaagggcagcatgccaggtgcaggaagtcctgtggtgtccatggcaagggtactacgggacgctgtgggaagggccaccacaggcccgtaagaattcatctgagtgggagatccagggacatagaggaagggcagcgctgcaggcccagggacagcggccaccggagtgacgtgagcctggctgccctctgaccactcgccggccggctgggtcactggactgttgtcactcgccacggcggaatcaggcaccatcacaggagttgctggtggagcagagccactcctgatttgggtgttgggaccggccggttcccggtgttgcggtgtgacctggtcattctcattcggagacgtgtgatcttgttgctcagtgtctgctggtgccagacaggatccagcagcttctggcttgtcctcctcctgatgtcttggtgcagacttgacacccactcttctcttcatcctcacgaggaggtgaggggagtctctttgaaagtaaggatggcagtagaactctaactataagtcaaagtttaaataaacaaaaggaaactgcaagtcacaaggatggactacaactaccaaccatctacgcccctgtgcaagagaactctactggcccaggaggcctttctggaaaaggtcccagtccccaaaggaagctggggactcgcgttcacatcgtcaaggtttaccaagttgtggcgggcctttccgtcttggaaaaagcctcaaaatggcagattagggtgtccatggccggcggaaagggtctttgaagttgcagaccaggagggaagaagattctgggcctcccccatgcagtgtcagctggcaacagaatgcaccccggctgggttggaggccctgggtactggctcttccacaccaggggcccacctaccaagggcagcaggagcatctgcacctcctgcgccaggcgcccttcagtgcttccacttgagcacctctccagacaccagctagggtgacagtggtacaaataccagactcccctggcctgctcacctcacagggtaatgtgctgtggagtcagggggacacagcaaccgccagatgacatggctggccccggggaggacgacacgcagatacggctacttggcacctgtgatattttacacactcgagaggggcccgcaccatcctcagccctctccccacattcactcttagttcatgtcacctccacccagagggggacacaggcccacagcgatggccccacaccctgcctgaggtcgcccacttcccaggaggcagtcctgggacttccacccgaccaggccccagagcccaccgacttaacccctccagaggcttgtcgttcattaccttattcaagatggagaccagcctttttgcggagaaaatgcgggtgaaggtcctgaaagtgcattgacgccgttttcggaagccatacaagtttagctggcggaagaagctctttatcgaagttgtggcaaacactttgtgtgcgacgtcccttttgagaatctccttttcaaagagtttttgattgatcactctacaagccccactgtcatcccaccagatggacgaaaactggttgctgctgaccagtctccacagtttctgtggaaaggggagggagaggagattatcttctccctggggcgggacgtcaccgtcagggtgcggccttctgaacgaagcttcctcggccagaggttggaaagcgatttcttctgtcagcagcctcaagttagggctcccagtggaccccgggtcgtcccaggcaggggaaggatctgctgggtgaaggtaggtctctgactgcaactggggagggaaaggcaccctttccaagccatgatcctgtcctctcgaatttctttcttcacagcgagccatactcaatgatcgcttgtcctccatctggcaaacttgctagtgcagtgtggccagcagcaccccttggcagtcatgtaaccagccccatgacatcataaaggggctctgactgccggggggtggcatctccacccccagcaagttgtgtaataaagggccaaggcagacaagtagctgcccatctgcatgtgcacattctggtcctcacagtcatttcaatgggaaagatgacactagtgcacaagagtgccgaggggccctgccacaccgtagatgcagacctggagcggtccccttgtcctagagctcctgagccaggcacaactacagcaaagccctggctcaggaaggtcagagctcaccgtctgagtcatgggcccacagaccccagcacatgactgacactcggaagcacagaacaaagggtaggacggtgcccatgggtcaggctgtagccacgccaccctttccaccctgtcctagccagaggcagcaatgtgctccatacagatcctcctaacacacccacactgtcggtccccagcacgcagatgcccgacagccccttaggcaaatggcttagctgactgccccaccacacgccgtcgccatgcagtccagtggggagtcggaggcagcctccttcctgcctctcctcggcctgcacgtgtccccccaccaggcagagacccttctacaccccgggtgtctgcggtcacatcgcggtggggcatgcagctgttggccttcgagcatgttttgttttccttggccagtgtctccagagaaacgcacgtgggtttgtgtccagcggtccatctctgcaacagttgttcctttgggattggatgctaggaggtcacgggagaggtgtccatccaaagcagtgtctgtgtcacacactgtccccacacacagggccacctctgcacagactcccccgactcgattctgggcacagagctcagtgaccttccagagactgccacgaaccggtgatgcctccacgcttgagacatcctgaccgcagggcccaaggcgcactggctcagggggtgacagtgaggggtctgcaaacagactgctgatgctcaacccggccgctgccgagctgtgtgacttgggcacgtcacttaacctctctcggcctctgtctcctcccggggataagagtagtagcacctgcttcccggggctgtgaggatccagtgggacgtataggaactagcgaggcaccggcagttgggtcagagctactgttgtcacttcacaaggcattttcttcaacagcaagtcggaaatctcatgagcctaaggcagaatccacctgtggcctctggttacaacccacaggactgaaaatccttccagccacagcaactggtgaatttcctggtcaattgccacaagtcatgagctgaaccccacttgagtttcagttcaggcagaactctagagacgactagggcaagctagacagcgactgcagagccttttgttgcagcgtgagcagtcctcagctgttgacatcactggggagcaaacgaggaccaggagcggtgaaaggacagtgtctgctgcagattgtcgtagcacccaaggaacactccagaaagcctcctaagcagtaacaagtgtggcaaggtgtagcccagccaacagtggcatctgcgaggcgtcccctccttcctcccactaccccgtataccctgggacctgtgcactgaaggactcattctaaaggctgtgcccctgcagccgccagcctcactcactggctgcctgtgccagctagagatttctttcctctgaggctggctgagaggaccactccagtttcctggcccatccagcaaagaagatacacatcatgcacgtgtaaaatgaggaaccggtttattgaacagcttaaggagagcaaaaatagtggctttagctacattttttacacactgagcaggaaagtctaaaccatcccgttcccctgtaccccaaagagaacagggcttgctggaggccagtgccaagggcggagtcgtgctcgcagcagacttgaattaaccccatgtaggccggcgagcagttgcccgcgtgaaaacaccaccctcttctcctggctgagaagatcaaagctctttttttaccctcttttcagcaaaggacctatttgttttcaggcaggaggatgttaaacttgcagcctctgacacacggtggaacctgcagtgcttggagaaacggcacgcacacgtgaaaacatcatgcctactccaaagccttcttgttgctggcaggagggaagcttgagactttcccacgcatagtcgtgacccgcgtggccgtttctgctctcagcaacattctctagtgttccggcttcaagcagcgcttgtcaggtttgaagctagccactattctgagaacgtcagaaaagcatggaccatctcttgcttggtgttgccgttgtggcagtagcagctactacgtacctgcacgagttccagggcagaagtggcaatgtcccatgaaggcgtggcaccccacggggggggggggagtgtgccacgggcgtccacttctgcagcagaaggcatgtgcctacagcacaagcttgtaaaaaaatacttgaacagaatatgctgtacagaactaggggttaacaccgcatatgaagatgctaaaacatttgtataaatactctgtatacaagcatggagtcactcccgtagaaagggctcatccgtgaggctatgaaaaactgctgtcagcatgcccaaagagaaactacttccacagtaggaacagaaaaaaggactgtgctgtgtctaaacacgtggtgcatcagagacatagttacagttcctactgactgccccagccacgacctgggagtgctgaggacctgggagtgctcagcgagctgcaggaggtcagccctgtggagaaatacatttctaaacaatacttttgattgggatttcagcaccgtatagacagatgttccttctgggggcctggcaagcagccatctcccagtgggtctgacggggaagaggggtacctggagcccctcccagacagacggtaatcccacccctgttctcacactcttcctggcatccgcatctgctggcacacacccccgtcacctgccacttccgcgtcccgtcgtggtgagtggctgataggcgctggatgcaaacaaggcatgagatggacgtacctggagacccagctccagtactggttctggtctgcggggtgaacgagggggcagaggaaggcggagagagtgcgtcccagtccacttaagctctgtccccggaagtggcatctaatctggcatttcgatatttaatttgggaggtgggagcacatacttcccagggctctgggtaatgaccaccctggccttctttcgaaacatgggtgcgattttagggggctccggaactggggtctcttcggtttcttcattatcttcgtgatggagatcataggaaatgtttccatattctcgtagaaatgggaagatttcaagcagaaactgacagaaatctttgcggataccaaaccaccctgaaaaataagaattttttatttcacacacgaggctcaactgaccttcctgttaactttctttccgtaacaagaagtttcactcctacaatgtcataacatactttatccagactcctgagtcacaaagcctgaacagggcttgagtacccaaaatggggaagaagtgcaaatgctagctctgtggtgcttggagtggggttcccggaccggcagggacagcgtccacggggcctagttagggatgccattctcgggccccagcccagacctccagaaactgagtcgggctagggtgggctccagcggtccccttttcctggcccttttgggattctgctggatgcccaagtttgagaactactgctccagtgagtctcaaaatatctgtggtgcgcagactacggtgtcttccgctaatcttctccagccaggataaactcatggatgacagtgccacccaagaacaagatttctgtcaccctctggaatccgtgagggcggtagtcatgcacgggtcctggccaggagggggcctgaactcatggagccaccttaaagccactttcccagtcccactactcctctctgtaggctactggagtgtcagctcggtgcaagccctccctgctcccgggtgcggggtagggggcagaggcacaaacagcaagcacagcccgggctgctgggctgcagtgaggccctgcccccaaacccactggctttccgaagggcaatgctctgggcttccgtgccatggagcccacagccttgccaggaaggcaccctctgcagagatcgttttggaagtgtctgcctcagcaagcaggtggaggggaatagagtgttagcaaggcaagacaggcaagactcgggtgatggcagcaaggatatgggggaggcagagaggccaacagggacctaggatgaatcccaggtttgggtgggagatgtggattttccatcaaaccctcccgggcctgggaagaatctgtcttgatccccattttgcagaggagggaacgggatctctgagaggttgcctgccgtgtctggttctacctcaaatggcagcgtgcactgcgagaaaagtcccggtgcaggccagcagaacaccagagttacggcatgcccttcccttagaaggtcccagaatttcctcagccctcactttcccacacaagcttctaaattggggccctcggggactcatcccttcctagacttctatccgccccccccccactccctggtccccccccagacacacaccaaggacttctgaaatgctgagtacatacagtggtttcctcccttctgtccaaatgtggttgccatcagcgtgatcaacgagagccaaagggggacaaagatcgggatgctggagaaggcgttgtggccatccagtttgtgaaccagcagaatctaaagaaagagacatagtcccggttgatgccagcaccgaaaatgggcagaggcggaagccagacttcattaggcagttcctccccaccaccccacccccgcgtgagctcccacaagagggaacatcagcaccgccagaaaaaggcaggaaaccacctatccctggggaaagctcgaaatgagcttttatgtccctcttcagagctcggcaatagcctatccacttgaaaagttcccagtgccagcagttttatggcaaactcctccgggtgtttgttctaaggagtcaacagctcccattctagaattctccacgtgactccaatacacaaatctgacatcccactctgctttccccagagtggaaactggagccatacagaggcaccatggctaaaaaggtgcactcttctccctgccagccccacgtgctgcccccaagagaaaggaaggatgctctcctttcaccgaagctccctctcggagatggctgtgttctctcccctctcctggagtgggctcactgtgagctcgagggacagaggctgcctttctaggggtgcagaatcctgtcaggggaagcgcaagcttcaggggctgaagaggcttcccgtggaacgcttacctcaaatgtaagaaggggcacgacgatggtcatccagctcagggccatggttatgtgtgtcctgcgctgctctgcaatcacatccatagagcgcaagaacaagacggaccacacaatgtagtagaggaccaccaggcacagaaaggacatgagaatccacagcgggacacacacaacctgggggtgggtgagagaacagcaagagaagtctctttagagcttccaacctggcctctgatggaaggcatctttagcaccttgctgtgtctgtccagttaaggcggtccttcccgtgagccgaataaggaccgttccatctcccaggactgctgggagcatcgctcaggacagaaaaggtatggtatgttcactatggggcctgctgccaccaggggacacacacgctcagtgagtcatcagtccctcttcctttgggtgacagacagccctgcacctggctccgcagcctctactcttccagaggcccactctcccacactctctcaggctcctctaggttctgctgccatcacagcttcccgggaaatgggacacaactgtcaccctgtgcacacacacaagatctcaccccaacagactctcttcacaggcaacattcccacaacctgctgggggtactttggcaacacaaatgggaatgggctccccagaaagtctggctgcctgggctcctaaggatccctaacctcacccctaccaagttagtgaacttggcgggttgatgctggatacaggttgatgctggatacgtagcgctgccgggtccccgcctccacggcaagggcgcattcccagtatgtccctgtcgtaccaggtagaccttgtctcatccacacacaagcccagaggacgagttccgggggcgccacttggccaggctcccctgtgacacgtcttcgccctcctgccctgcctcctgggacgacactcctccgttctccctttttattaattatctatcatacagtaggaaaagtgaccgtcttcctttggtgtgagttccctgagtcttcacacaagtagattcgcacagccgttggcaggatgcagaagaggtctgtcaccctgcaaaactctccgtgctgtcccttcactatcacaccgtccccaccattagccccggcaaacactgatctgttctctgtcactgtacttttgtctctgctggaactttatgtagatggcatcgcgagacaagtaacctgttgagactggcttcccgccatccacataatgtctctaatgagattcatccaagttgttccctccctgtatccacaggtcgttccctctcagttctgagtggtattccattgtatggatgcctacagtttatctgactgtccgctgagggtggtttgtgaaaaccaaacaaggccgctatccaaaatgcaaacaagactgctacaaacactggtgtgtgggtttctacaaggctgcgcgctttcacttctctgggggtaaatcttatacccaggagtggggcagccaagtcccacgggaagtgcgcttttaactgcatcagagatggccaaaccattttctacagtgcccgtaccacctgccttcccgccagtaacactggagtgtcccagttcctctgcatcctcccaggcacgtggcctcgtcagtgttgctgagtttcaccattctgaagccatgtgtttcgggccctcatcctggttgtagtttgtcttccctaacctgtaatggcgttgagcatcttttcctgtgctttttcgccatgtgtatatccccttcgcaaattgtcaactcttttgccaatttttaggtgtttctttttgcagttttgagtttttaagagttctctgtatgttctgggtgcaagtcagtgttttgatgtgtgctttgcaaatattttctcccagtctgtggcctgtctttattttatttttgaggaagtccaaatttatttatttatttggttctaggactggggcatagaaaatacaaggtgagcttagcattttgtggcgcaggaaaataaagacgtgcttaagaaatgatgcagtatataaaaagggtacaggagcttccaaagactaaaagggctcccaaaagctggaaaatttgagcaacaatataaataatggtagtactgaattataagcaatagaataaaacaacaatttagatttttctcaggtatgagcatggattatctcttcatttatttagatgttttcaaatttttctgtcatattttgtagttttcagtgtacaggtcttacaaacttttcattaaatgtattccaaagtattttatgttttgctattcataaagcacttgctttttgtcattttcatgtgtttgctgttagtatagagctatagtattaatttctttgtattaaatgtgtatcttataaccgtggtatattcacttattaattgcagttttccttttttctttgtagaatccttaggattttccacactgaccatcatgttgtttgcagtaaagaccattgtatttcttccttttgaatcatgtttttcatttctttctcttgctctattgcaatagtttgaacctctaatagaaaaagttgaggagaagtatgaaatccgttatttttgccttgatcctgaccttagatggaaaacattcagtatttcatcattaagcatattcttagctctagtttttttgtagatttcctttaatgaattgataatgctcacatatatttttaatttgctgagaattttttaaaataaaatgtgttgaaattttcaaatgatactctgcatttaatggtcattagatcttctttgctcttactgattttctacttttctctatcaattataggaatcttatataggtcctaagtttaggtctagataaagaaagaataccagagaagaaataaataaaggtaaaataaaatgctttcttattcttaactgacctaaaaggtaactatttatttaagttaataatagtaacaatgtatcagacaactagtgtatatggataaatgaaataaatgattgtaatgttacaagcaatgcaatgaaggaactgagtatactcttttataaggtatctatagtacatatgaagcagtatagtgttgttttatggcatgttattaaaatatatattataaactctaagacaaagactaatttttttaaaaaaggtgtaattttacatgtactaaatgttttataaagcgaaagaagacagaaaaagaagaggaataaagaaaaattaaatacatagaaaacagttacatgcatggtagatattaatgaattatattaataatctctttcagtttgaatggtctaagtataccaataaaagacaggttgtcagaattaataaaaaataatactcaagaacatattgtctataagaaacccatttttaattataaggactcacataagttcaatgtaaggaggttgaaaaaggtattctaacactgacaaaagaaagctggaatagctacattaatttcatatttagagtgtctaaagttaaaaaaaacagacaatatcaattgctggcacggatgctgagcaaaaagaatcattcattgctggtgggaatgcaaatagtacagtcactttgtagtacagtttgtgagtttcttacaaagctgaacatagtattaccatgtgattcagagaacacacccctaggtattaatccaagtaatttgaaattttaattctacacaaaatcttgcatataaatttgtatcatagcttattttataattgtcagtaatggattgaactaagttgttcttcagtaggtgaatggataaacaaactgtggtacaaccatttaatagaacactattaatcaataaaaagaaatgagctgtcaagctatattagtctgttttcatgccgctgataaagacacacctaagcctgggaagaaaaagagatttaattggacttacggttccacatggctggggaggcctcagaatcatggcaggaggcgaaaggcacttcttatatggcagtggcaagagaaacaaaataaggaagaagcagaagtggaaacccctaataaacccgtcagatctcttgagtcttattcactatcacaagaatagcatgggaaagaccagctcccatgatttagttacctcccccctgggtccctcccacaacacatgggaattctgggagacacaattcaagttgagatttgggtggggccacagccaaaccacatcacaagccatacaaagacatggataaatattaaatgcctatccctaagtgaaaaaaaccagcctgaaaagtttagatagtgtatgatgatacaatttatttggcattctggaaaaggcaaaactatagagacagtaaaaagatcagttgcttccaggggttgggtgggtgagggggaaggattgaatagggtaagcacaggggatttattagggtgatgaagctatcctgtatgatactgtaatggtgaatataacactatgcatttgtcaaaatgctcagaacaattgtgacccctaaagtatgcaaatataaaaaaataatttaggaggtctgaatatcccaggaaagaatggacaatatgacaaaacagaataactatatattacaaagatatgaaacaacctctttaatgaatatcaagagaaaaggtgctggcataagtaactgtggaagtgagtagagcctgtaagaataaagttagaaggaactcaacactccagaaaagaagggccctccaggattctggctgttgccgattgtcagccctaggatgaccctggcaagaggctggctgtggcatgctctcacttctgcagtggggtgagagtggggcttcagggaggtaaggccttggtctgaaatggagaactcagataatcaagggctaggtttgggataggagtaaattgaatgaaaatagtggtttggatggaaaagcagctgggagggagagaatgagttggtctttcactcaactttcaagatctttgagctgcatccagatggggaagactcttatacgcccaaattaaataataggccatctcggagggaaattttactaacttttattcacaaagcttcaattttgactaatttgatattatatgttctattgagctgcatattctctgagatattttagataacaacagaagtaattcccaaaggaggttatagtaagatgtggtctaaaaataatatttgaaaactaccatttattaaatattcaatatatgccaggcactgtgtcaggcaattcaatacatttcttacaacagtcttacaaaaaaatgatctagcaaatagaatcttgttgtctcctgttcttggctctatggggacctgatcacgggtggccctaagtgtcaagctcacttgtaccacaggcaggaagttagggaacccacagggagatggggtcttggtgtaaagggcaaatgtctgctcatctcagggattgggagccgaggaatggcaggccccagcagatgtaaagatgaataacccacaggaggactttggtacacccatcccagaaccaacagggccagcctttagctctggttggggagaagcccctgtaggaaggtgtgggtcttctcccagaggtcactaaaatcacaggtgctgaagacccccaggaagcacctagcctggaacccacggccattctctgcaaggggtgcagttggcaaatgctcagaggtgacagaaacagagcatctcccacccatcacttcatcaaagagctgggagccaggaggaagagtctcctgagtgagaagtgagggtccaccgtccccacatagaggggccacagaatccagctcggtccctcctgtcagccctggaagaccttggcaatgttgtcccccgacctgacacctccccctcactgccacttcaggggactcagagtcagagacttggtctgaggagaggagacaccattggcagaggacggagctccaggctctgcagagaatgaaggacagaaacctgagggaggattgaggcacctccatgaccctcgaccacatctgcacccctcgccattactcttccccctgcccccaccccagcagaatcgagtactgccactgctgtcaatccagggaagctccaggcatgggggccagatgtgacctccactggcttctgcctctgggatctgagagaagagagagcatctctctgaggggtgtcttgagagtggcagaaggcagcgggcccaggctccatgaggaggcaaggtgagagctgagggaggactgaggagtcctcctacccagatagagggccccaaataatccagcgccaaccctggagccagccctgaaacaacaggggaccaaattatcaggctgagacaatccccctcctcaatgcccaaggagactctgcgagtctatggtgtgacccgggcagaggcagttccgtaaagggtggggccctggcctttccagacatcaacatcaggactctgagaaattatggagaggttccaccccatcctgatagaggggccccagagtccatccttgtccctgcagtcaacgcaaaggacctccgggcttggtaccgcggacttgcacattagggggtcagagagaagtgacagcccggttctgaagggcggcttgtgatccgctgagggcagcgggcccaggctctgtgaggaggcaagatgagatgctgagggaggactgaggacgctccctccccagatagaggaccccagataatccagcaccgcctctgctgccagccctggatcaccccatggggatggacttctcaggctgggccgtcccctccgacacccccctcggcttctgccccctgccgcttaagcctcaagggactgtggggtcagagcttggtgtgaccagggcagggctggttggggggggcaggacccaggttctgccaggcatcaaggtcaggaccccgagggagggctgaggccccacagagcgaggctccctctctgctgtcagccctgggaagttcctggcattgctgccaggcaagtggatcctgatttccgcatcccgggctgaccgagggaagaggcttggtatcatgagaatggcctagggggagcacagataaggcccagtccctgctgggagatgagggaggcctgaggggacccagcaccccaggacagggggcccaccccgcccccatcttagactgaggtgcctcctcattcggcgttgggaatctgagggatggagactcaggtccgcagaggggatctctggttcagccctgccaggatcaatgggaggaagagggaggactcaggaggccttggactccagttcagtggggaccttggcccttggagttccaaggcacagtgcccaaatgtggtgcatcctcgctctgcctttggggtgtcagagaggagtgggttgtggtctgaggagtggagcctcaggtcaaccccaggagaagtcccagagcactgagggaggactcagacaacaagttatccctgaggtagaaatcctgcccctgccatcagtcctgggaggccccaggcaggactctaggaaagagaggcagctccccacttcctagttggatttctctgggagatggtggtcttggcctgcaaaacccatccacaattcagggatacccaaaaaggacagcaggaggtggtgatagtcagctgggtccatgtgtgctggggtaaggagcctgtttggtccccatctttggtgtgtatctgggcctgggaccctccctcttttgacctaaggccatctccttaaaccaaagctctatctccaggagacatcagaagaggagatcagggaagtggaaacacccatggttcccggggacttcgcatggctgacagaaggggcagggaagggctgagtcccatgtttttggtaagtgctgtcccgtcagccctcaccttgattctggtcatggcctgggaccctcccactgctgacctaagtgcagccctctcagaccaatgcctccccctccctgagaccaatgatcccagtataagagagggatctcagcagatagtcctgcacatgctctctggggagacagcaggggcagagcagatttctaagcagccatctgtgttctggccaggaggaaccctcaatcctccctcaggtttctcacctggactcttggcagatcctgggaccactgtagttgtggaccatacggggctctttctgttgactggaagtcgtcctctgagaacatagtgctcacctgcccaagattccaaaacagaagtaaggggccccacgtcccatcaccccatcatgtggttgtccagggctgacagcagaggctggacccttctgttctggggattccaaagtcctcctgtgggtttttcatctttacttctgccagggcctgtccttcctctactcccaacccctgagatgagcaaacatatccctttacaccaagacttccctttacaccaatcttcagggaatctccctgaagattccccaacttcctgcctgtggtacaagtgaccttgccacttagagccacccatgatcaggtctccaaagagacaaggacaggggacagagagactctgtgggatcccttcattatgggatgggggtatctccagtcctcacgaggggttcacatcttgagtcctaaagatcctgggactccttcctctgctgaccaattgtggctccactgctgacctacctatcatcacccccttggaaccagatgctcacctccatgaaacctcccacccccaaccacctggcagaaatgtgagcatggcacatacctcccctacctggggcctccaggggatgaagggaaaggggcaggcattgtcatgagtaaatctgaatacctggaggacacccagagagagcaggcaccctgaaatctgctccatctgtcagcctttggcatgccatgcagggctgtccgtgtagtgccccttcactttgtgcctcccacatctcagagaggtagggcccttggtctgaggcaggttgtcaggtcagcagagggatagacacctgctcagcacagggtggagtccaggatctgccagtgggtccggaattggtgggttcttggtctcactcacttcaagaatgaagccgtggaccctcacggtgagtgttacagttcttaagggcggcgtgtccagagtttgttccttctgatgttcggagtttcttccttctggtggggttcgtggtctcgccggctcaggagtgaagctgcggaccttcgcggtgagtgttacagctcttaaggtggcgcgtctggagttgttcgttcctcctggtgggtttgtggtctcgctggctttaggagtgaagctgcagaccttcgcggtgagttcgcggtgagtgttacagctcataaaggcagtgtggacccaaaggatgagcagcagcaagatttattacaaagagcaaaagaacaaagcttccacagtgcgaaaggggacctgagtgggttgccactgctggctggagcagcctgcttttattctcttatctggccccacccacatcctgctaattggtccattttacagagagcccagtggtctgttttgacagggtgctgattggtgcctttgcaatccctgagctagacacaaaggttctccacctccccactagattagctagatacagagtgtggacacaaaggttctccaagtccccaccagagtagctagatacagagtgtcaactggtgcattcacaaaacctgagctagacacagggtgctgattggtgtgtttacaaaccttgagctagatacagagtgccaattggtatatttacaatccctgagctagacataaaagttctccaagtccccaccagagcagctagatacagagtgtccattggtgcattcacaaaccctgagctagacacagggtgctgattggtgtgtttacaaaccttgagctagatacagagtgccgattggtgtatttacaatcccttagctagacataaaggttctccaagtccccaccagactcaggagcccagctggcttcacccagtggatcgggcaccagggccacaggtggagctgcctgccagtcccgcgccgtgcgccggcattcctcagcccttgggtggtcgatgggactgggtgccgtggagcagggagtggcgctcgtccaggaggctcgggcagcacaggagcccacggagcgagggggaggctcaggcatggtgggctgctggtcccgagccctgccccgcgggaaggcagctaaggccaggcaagaaattgagcacagcagctgctggcccaggtgctaagcccctcactgccccgggcagggggggccagccggccgctctgagtgcgggcctgcccagcccacacccacccggaagtcgtgctggcccgcaagcaccgagcgcagccccggttcccgcctgcgcctctccctccacacctccccgcaagctgagggagcctccgccagcccaggaaggggctcccacagtgcaatagtgggctgaagggctcctcaagtgctgccaaagtgggagcccaggcagaggaggcgccgagagtgagcaagggctgtgagggctgccagcatgctgtcacctctcaccagtagtcaaggagaggaatattggtgaagactgaaggtaagaaggtaccctctcacatgccaagaaaaagggatctcacaaatcccagcttcctctgtttccctcggcctctcttatgatggcatactgggtgatgagcagagcatgcccaagtctggcctcctgataatagtcctgggtgtgatcttcatggaggggaactgcgtcccatggaggttatgtgggaagtcctcagcattatgggggtgtatgctggaagggagcacttcctctttggggagcccaagaagctcctcacccaagattgggtgcaggaaaagtacctggtgtaccggcaagtgcctggcagtgatcctgcatgctatgagttcctgggagatgagagaggcctgaggggacccagcaccccaggacagggggcccaccccgcccccatcttagactgaggtgcctcctcattcggcgttgggaatctgagggatggagactcaggtccgcagagggatgggtaagaagtgggatccctcccattggcgttggctatgtactcaagaacttgcatcttgctggtctcagggtgggcccttggaccccacaggggacattggtggaaacagcaacaccacatgtcccttattggacagagcaaagggatatggagaatgctcaccctgtgtttcctaaggactgcagggctgcagcagctaggacgttccatgcaccccacatcctctcctacaggcatttcagggtccagcatcctccacagcagcctcctgtatggacacacatcacacaggactgggacaattctgaacatcacagggcagagcagatgggagcatacctgtgcccatccgtggataggtcttgagggtttccaggtgccccaaacctgccccctgaggggctggtgagagacctctcagccatggtctcacttccctgagaaacctccctgttccaccagccatggctaaaccccctactctgaactccagcctccttgacaaggggctgatctcctgcctggctcttgccagcctttctctgtggcaattacccctggtaagtgttctatagcccttcttgagcaagtatggggtcccagagcatctagccttattagggggctctggtcacagtccaagtgagaggaattgtgaggccaaattagggcagtggttgaaaggctggagatgagggatggatttccgaggtatcgcacagggggaagaggcgggtcttgtgggcgagtccagcttagaggcttcaggggaggaaaggtctgaggacaactcagaaatggttggcgtcacatttcctagttctctgtgcttgtgtatggtttcttttataaaaattaaattcatcagtctgcaaagtttccttttgttacctccatttttaaaatttcatagactttatttattttgaggtattctatgcttgaaaataattttcaaagatagtacaaagtttctatatgcctcctccttcagtttcaggttcccctattgttaacatcctacatgagtatggtacatttgctacaattgttgcgttacgtgttactaactaaaggtcactctttattgagatttatttcatttttacctactgtccttttggtcctccatgattccatccaggatgccacattatatttagtggtaaggtccctttagattcctcttgggtgtgatacttctcttgttttggatgatcttgacagttttgaggagtattggtcaggtattttgtagaatgaccttcagttgtggtttgtctggtacttttctcatgattaggctggggttatgggttctggggaagaagacaataaaggagaaatgccattctcatcacttcacatcaaggctacatattatcagcatgacttattactaatgatgtttaccttgaacacctggctgaagtagtgctcgcgaagtatggttactgtaaagtttctcttttattcccctatttcatagtgttctctttggaagaaagttactctgtgtagcccacactatgagcagtggggaatcacattctgctttcttgtgagagtgagagtatctgcataaattgtttggaactctttcccatgagaaatttgtctgttcaccctcatttttgcatttaagtaatcatttatttatctcgatgtggacttacggatactaattttacactttgtggaaaatccaatacaactttatatgttctgttgttaaaattactccaggtttggccactgggagcactttctcttagttctctttgtacatgtctttcttatacatttgtcaatgtgtttaaatttttttttttttttagtatttctttactgtcaagcacaataagatgttccaggaatagactgcatatttcctgatctgcttcaaccatcagcaatttctccactgagcccattttttaaaattggagaatggtattagaaatctagatctgtatattaggtatgctcattcctactggggtgttggtggcatctgctgacagagcaagaaattatatgtgtgtatagtaacctgttaatatatctataaatatttctagatgcaatgatctgcatgaatattaagtcaacagtgagttcttcctaatatctctaactcaaatctgctatcgcagagatcattacagcctcctctccttgtctgtctggaaatttttacttaatagtaagaaaccttgaggttgacaactggtttgtgtgtcagtgtcatgttgcttttgctagatagcctctggggcctggacaactctgggaggactgctaaaactgaatttgtgggcctgcagagcagtggttcagctccaggactccctggatctcactaaaatagcgtctgctctcaaggctctagactctgaggagcttgagtgctttccatctatgaagctcttgaaaaggcaatggtgcctgttattcaagtgtctgaactgacaagccatctcccccttcatgcctgctttgggcatgatcactggtaataaagatgttgctgtccgataggaacactggcaagcacctctttctaacagtatgggctgcaggttcagctagaccctgagttgcatctgtgctcctccacccttacttgcttggtggctcaggacctgttacacaagcttctctgtgccttagttcctcgtctgtatttgagtgttcattgagaaccacctctgggctacacattggactttacccagaggatgggaaaggaagctggacccaaacatctgaggcagggtcctaatgcttcagcagatgaaaacttgatttcggttactcatctttaaaattagcttgtataataatatccattccccagtaggtgttgggaagcttatttaccatttatgacttttttttttttcattctcagaagaaaggtgatgcatcatggctaagtatgactatcacaattgtgattctctcaagctgcccttggggctaaccaggataaaattgcccattgtgaaaatgtactattatataaagtatgactattttccacaatgatactatgtggatattcaaggtattgctatcatcatgaaaaactcttaaattggccaaagtgaagatagactagctcatcttttgaggtattatgtgctccaacacagacacacgcatagcatctacaaatactgggattttttttttaattccatacatttaagaaaatctctatcaaatcactaggtggccgctaagctaataaattaagagatggcagtgtctgtacatgacaaagaatgtagactttaaaatatagtccagaaaagtcactaaacaaacaacaaacccctacaacccagagcaagcaaaatcaagaagtcctgggaagggggaatatatatatatatatacctattacagaagtaataggtatatatatatatctattatatctatatatagatataatataatataggctgaccagcagctagaaatctaaggagttctgccattggaattatctaacatttcatagctcagtgcagtgattttcatttttaaactttcattcagcatcagaaatcatacttaacctcattatgcctgtttcattctaatgctcaacactctatttgtaatccattctttatgttcaattaagccaattcacctattaatgtggttttaggtggttattagcacagactggagctattactgcttcaatcaaaccagactactggcacttgtggtctcaggtgccgcctgacattttcacaatggaataggagcaaaagtttaaacatttcctcctacacatcctgtcatcttccttctttgccagctctggaccccccataacttccctgccactctggccacttcgattaaaggtactagttaaatatataatttatatatgtatatatatataaaatatatgatatatatcctatattacttctgtccctctagagaaccctgactaatacagatttttggtaccaggagtggttctagagaaagagaatattaaagattgagttcttttgttggtttgggcatttctggagttggttgcctaatatgattagaccccaaaaatgctaaggactctacttctaatagtatggaaaacacttttagcctttgacatgaactgtttagagagttatttaaaataaatgcattcgacattcgtgattcagcacttgtgagaggcaagaagtttagtgactctatacataatacctttggccatatgcggcgaatcaaagaacataatgaagctggttagttgctcctaagttcagtggacaaagtgatgaaagaaaatgatgaactcagggattctgtctcccggcttcagaagcagatactgagcctcaaatctgctaagattgccctgagtgagagtcttatctcctgtagagaaagagctaaaattgtgggaaaacagacccaaggtcttatcatgtgagttgctgacctgcaacaaaagatgcatgcacagcctcaccaggggggtactgttaaagtgagggcattgattggaaaagaataggaccctgcaacttggaatggggacgtgtggaaggaccctgatgaagctggggacgctgagtttgtaaactctgatgaatcttttttgccagaacagtttccccatccccagtagtggcaacattccctccctgacccatgctgccatcagcccttccacctttgtctgaggagataaaccctgtgcttcttgaggcaacagtggtggcctcctctgaggcagttgccaggtgagataatgttgattctcctcaggtgccaccccaacacccctttttacttctagacctataactagactaaagtcccggcaggcccctggaggtgaggttgagagtgtgatccacgaggaggtgcactacacccgagaagaactgcttgagttttctaatttctgtaaagagaaatctggagaacaggcatgagaatggatattaatggcatgagataatgatggaaggaacatagagttgggtcaggcagaatttattgatttgggcccactaagtaaatactctgcttttaatgttgcagcttgggaagttaaaaaaggttgtagttgcttatttgcttggatagctgaaatatggattaaaagatggcccactgtgagcagctggaaatgcctgatctaccttggtttaatgtagaggaagggatccaaaggctaatggagattgggatggtggagtgtattagtcatgttagacctactcatcccagctgggagggtccagaagatatgcccttgaagactgacttgtgaaatagatttgtgaaggcagcacctacatctttgaagagacttgtaattgctcttttctgtatgtcagatctaatggtgggaagtgcagtaactaaactacaaaatttaaatacaatgggtataattggatcccgaggtggcaggggccaagtggcagcactaaaccgccaaaggcaaggtgggcatagctactaccataatggacagcaaaggcaaagcggcaatcagaataatcttacttgtgtagccctatggcactggctaataaatcatggtgttcccagaagtgaagttggtagaaagcctacgcattcctacttaatttatacaagcagaaaacttctagttagaattgtcaaaagactaatttgaattataaaaacagagaatcacgacccctctatcagtttctagacatgagccagtttacagacccagaacaccttgaatgaagtggaggctgggtccccttaaggaaggaccccactacattaccgacaatttatgcagtgaatcgttctcctatccttccccaagaagacctcctgccttttaccagaataactgtgcattggggaaaggacaacaatcagacatttcagggactactggacactggctctgagctgacgctgattccaggcgacccaaaatgtcattgtgatcctccagttaaagtaggggcttatggaggtcaggtaattaatggagttttagctcaggtctgacttacagtgggcccagtgggtccccagactcatcctgtggacatttcaccagtgccagaatgcataattggcatagacatacttagcagctggcacaacccccacattggctcgctgactggtagggtgagggctattatggtgggacaggccaaatggaagacattagagctgtctctacctagaaaaatagtaaatcaaaaacaatattgcatccatggagggattgcggagattacggacttgaaacatgcaggggtggtgattcccaccacatacccattcaactctcccatttggcctgtgcagaagacagatggatcttggagaatgacagtggattatcgtaagcttaaccaagtggtaactccaattgcaactgctgtaccagatgtggtttcattgcttgagaaattaacacatctcctggtatctggtatgcagccattgacttgctaaatgcctttttccctgttcctgtccataaggcccactggaagcaatttgccttcagctggcaaggccagcaatatacctctactgtcctatctcaggggtatatcagctctccaggtttgtgtcataatcttattcagagagaccttgatggctttttgcttctgcaagatatcacactggtccattacattaatgacattatgctaattggatccagtgagcaagaagtagaaaacacactggacttagtagtgagacatttgcatgccagaggatgggaaataaatccgactaaaattcagggaccttctacctcagtaaaatttcttccttttttttttttttttttttttttttgagacagagtcttgctctgtctcccagactggagtgcagtggcgcgatctccgctcactgcaagctccacctcctgggttcacgccattctcctgcctcagcctcccaagtaactgggactacaggcatccgccatcacgcctggctaattttttatattttttagtagaggtggggtttcaccgtgttagccaggatggtctcgatctcctgacctcgtgatccgcctgcctcggcctcccaaagtgctgggattacaggcgtgagccactgtgcccggccctacctcagtaaaatttctaggggtccagtggtgtggggcctgtccagatatttgttctaaggtgaagaataaccttagaagccccaacctggggcttccctgggttgacagcatgggcagaaacgggttctgcctggatttgggtgggggtggttgttaagatgtggggtgcgggggtttagggggaggaattgggggcggtagggggagggattggggtgggacccccagggcttaggtcttggtggtggtgggtttgggaatgggggtggaggaccctcagtcatccctcggggtcctgaccttgatggctggcagatcctggacccccattctctgctcccctcagaccaagtctctgactctgagtcccatgaggtggcagtcgggagaggggtgtggtcgggacgacaacattgccagggtcttccagggaatgacgggaggggctgagttggattctgtggcccctctatgtggggagggtggaccttcagtcctcactcaggaggatcctcctcctgactcctggctctttcgatgcagtgatgggtggcagatactctgtttctgtcacctctgagcctttgcccagctgcaccccttgcagagaatggctgcgggtcccaggccaggtgctccgtgggggggctgcaggagctgtgattgtagtggcctctgggagaagacacgcaccttcccagggcagctcttccccagccagaggttgaatttgcaaaccttttaccctaaaatatttatttttacattgagtaggctgaccagcagctagaaatctaaggagttctgccattggaattatctaacatttcatagctcagtgcagtgattttcatttttaaactttcattcagcatcagaaatcatacttaacctcattatgcctgtttcattctaatgctcaacactctatttgtaatccattctttatgttcagttaagccaattcacctattaatgtggttttaggtggttattagcacagactggagctactactgtttcaatgaaaccagactactggcacctgtggtctcaggtgccacctgacattttcacactggaataggggcaaaaatttaaacatttccttctacacatcctgtcatcttccttctatgccagctatggactctccctaacttccttgacactctggccacttcgattacaggtaccagttaaatacagtcttcattctccctcagagctttctcatgttttgttgtttagattttgttgtttatactgtttgtttgttattttattcttccttctatagttttccagggttcgttttgggagtgaaggacagaagcccaagcttgacgttcatattgccagctaaattttaagcgttatatctgtacatcttggataaagaaaaattgacatcttttcaatagcctgttccctattaagggatatggaatatggctctatttatctgggaagtttttgacccgaatctatcagtatttgcatagttgtttccataaagatcttgtatggtttgtctgtcttattagacaatttctggattttgttgccattgtgaatggggtattttctattacttgttctgagtggttatttcattgggttgcaaggattttgattttactgtagtaacctgtatactattattctgaagtctgttatttgactattccatgtgcacatttctttgaattttctagataatcatattgtcataccaaatattaactctttctgttcaatattcatactgatttcttttgatatccatatctcctgccttatgttacatgcagtttccaaagatagaggttatagcctatgtccatgacaagaattcttctaacatttcatacttaagtatgttgtccattgatctcaggaaaagaaaatatgctgctaaacttattttgctaaatgttttgaccattaacttgtatagaatttcatccagaagcttttttatacctactaaagtgatcactttttaaaatcttaattcgataacgtaggaaatcacaactgaaaattgttttatattaaatcatgtttttgttccttggacacaatccgttaattcacttctatgttgaatatgctactaatttaattaatatatttgcctctgtgtgagtgaagtttggctcaagtgttttcacggtgctgtcctcctctggtacctgaatgaagaatggttagcttgggaaaataatttgaataattgcccaacttttcgtatgccttggaagagtttacttaaggtggctttgagctttacctgataacaatgtagaattggcctccgaagctgccttgtccacatttgaggatggcttgagcttagattagtttcactttttattgtttggttaaagatttgaatttctttttgtatcaatttgttcatgtacttattttcctaaaatattatccatttcacttaggatttcaaattaaatatcatatttatttcaaaaatattttcattacaagcattttcaaatacacctaataatagggtaaatactataattaatctaatataccagactttcagtatcaataatcttcaactcatggccaatctggttctagttatacccctacctactccgcatagcagaaactgaaataatgtggagcaaatccaagacaccatgtgatctcatctccaaatacatcagagtgcatttctaaagataactactctcttataaaacataaagccaacattattatctttcctaaacatgtaagcaagtcattaatataatgaaatgttcacttatttgtcacatgtatctggtggacatatgctcctgttaaaatgcagtttctttgaatcggtttgcaaatatgatctatacattgtgtttatgttcttaatagccaccttaagtaatttatagattcccccacattacctttttttgaaactcatttgttgaaaatgaagacatgccttgtgttctgtccagtttcccatactctggattttgctgagcgcaatacttctcttcctgcattacctatctgtttttccatgttgcctactttttccattaaagcctcttaaatttttaaaaatagtcattttaaattatctgcctcctaattccaatatctgagtcatattagagtccagttctgttgattgtcttgtctcttcagactatgtattttcttactcttttgcgtgtgtcccttgcaatccttttgttgagagtgaacgtgttgtatgaggtcataggaacagaggcaattagatctctacagtgaggatgtatgtcaatttggctgggagttgggctttatttcttatacctatagatgccagaggcttcagattcctctagtgtccttgtttttgtcttccgttttattaattgtggcaaatgtgtaatgctaatgtaagaggatggtaatagggaaaactgggtgtggggtatatgagaattctctgtactatctctgcaataattctgtaagcctaaacattttctaaaataaaaagtcattaataaagaatgacttgttggaccccattggaaggaacaagaataaccacccctcacattgagaattggctctgcaagagagagaataaaacatttatcctgcatttcctgtactaactgtatttcaggatgacacaatagctacagttgatgaggaaagtttcttccttactggagaattccagctgaggaaaatgcaacatatgagagaaaaggaaaacaagtatttgcaatatccagcaatgcaactgatgcaatccatgctaatcaatggatgaaacattgttgaagggttgatgacgcactctgcaatggaggaacaaggctgtctccacctctccacctgagcccactgatcagagccaatatgatcaagggttgaacagccagaagttgtatgcctcctgctggagtacagtaggaagcacaaagagcctcctatgtgtaccttcccccccaacaaaaagccaaacctgcttctggcctccacctgaggtgaactttgaaagataggaaatccagtcctggattaagacatctggcccctcattgaagacacagagtctactctggaatgagcactaggtgtcaccagacagccttctgctttgttctgcacccagtctttacacgtgcaccattgtcctgcccgccgcagcagtgccacagcagcaggccaacagccttgcctgttcaatgccaatggtgccttccatcccctttatcccgagagaaaggtttctggacacctagacctgtattccgtacccagtcctcaggtcaagtcagtaacctggaatagaaacctggatccaagaagccagttcatggtacagtgcagctgacctggctctgaggcagtccatggctcagaggatcagggaataccctttacctggctcaccagaccagtgtctctagaccctgccctctacactctgttccaaggccccgagcgactgcatgtctttgttctcttctagacgattgctcttataatactgttagcattccttcccagacatcctcggttctctctcgagatatctcttctgtgaggccttctatgaataccattgtaaaaattgcaatccctccttccacccagtttccagcactccttatttagctctctcgattcaatttgtttccatagcgtttgtcaccataaaacctacttcacctgtaactttgttccgcagttcattgtgtgcctgcccctcccctcccgctagaacataagctccacagaagcagggaatttgttcaatgctgtatcctcagagcttagagcagtgcctggcaaacagtacatgctcagtactcagctgtgggacgcatgaagaactacagctccatggtcctagtattcgcagcctctgcattggagcctcgtggcattttcagtcctcccaattacccagcaatcaaagtttaaatgcatcccagcaccctcttattgttgagtcatggaacaggtaagcaactgagctctagggactccagagacctgctgccccagcgcctggtctgtgctcctggcatcctggggaagtcagcaaggcagggctacaaacatcagtggctatctgagcactctctcttgccagtaggcagctgtggcccttgtcccaattccctgctcctctctctggtcgtttgggtctgcaagcagccaatgtcaaggtctcacatgtctctgggtttcagctgggccttaaagggatttatgtaacattcagttcaagtaacactttcccattgattcctggacaagctctagacagaagtcccatgttcgccaatgactttgatgctacttccctggagaaagtaggaagggtggccaacgtggtttgcaaggttgcattcatctggagaatgctccatcatgatttctccccaatgccagtagacaggtgccatccctgcctttgtacacaccgttccttgctgcgtgaagttatttgaggaatcattacacactctccaagaggtaacataacatgatttcattcgctcattcattcaatatttatccagctcctcatatgctccaggcactgacctaagtgctggagatactgtattcactataaaaagggcttcccacctccgtggtgttcttcctaataatgcataatcatgcatgcccttctaatcgtgagaagacattagacccactgaaactgagggatgttctacaaaaatcagactagtattcctagagtcctccaagacagatttgatgccaagatggggaagaaggaagagtatgttggaggcctaggtccttgcagacatgttctggagatacacactggggtttgggagcacagcaggagggactgtggagtgggcagaaccctccagggagaggtcaggggagcagtgcaggagtttgaggctgcacaagaatgacatgacctccatgggaagagcacactactcaccctccttctgagatgaagcattctcttccccttcctttagccatgtgacaggatctggtcaggtgaggagaggagtgacacagatggggaactggcaccaggtcctcaggggatggcaggcaagaagctggggctcatgaagctatgtgaggcagattccatagaaggagactcgggagctttgggtttcattctcacatcctgagaacacatccagagacttaagtcatacacatttgctcccttctatgcgagatgccagattctgtactttgaaggccctgggcagggatggaggtcttcacaggaagcaacaccccgtaggaagctgactgcaggaattcctgcattgccatctgcaccctttgggccctgaagcatgacccatcagtattttaagagccacgatgtgtccttgaattggaggctggcagccagcagtcaaatgcccttgttgggattgcaagtttccttctcctggggcccatagttgtgttctcatgtcccctgctgctgtgtccacactgccccaatcgggcctcagtctgcccagcttggggctttgcgcttcctctctccccactaactactgctcaagacctggagctgatgctcatatgcgattatcattgtgataaattccctggtaaggatctccttccaaggtcttgtggtgacagaactggcaggagatgatgaagccttctggggaggctcctagtgaataataagcattctgacatgatgagtgacaaatcacgatgattaggagatattattcaaataattccccaggtaatgtctggcttttgattaaccgatcaccttaaatgggtgactatgaggttttgctttctcaggctgatgatccagagaggtggggctggggtgtcctagcagaggcagctagggcctcggtatccccagacaggcagctaaagaagactaaaggctgtagcagatggtgggggcgttgagtatcgggacactccgcagtccgcagaatactcccagatccacgttaggacttggaaagcagctgggtgtgagagggctttggggtcctgagggattaggctgtgctgagcatcagccaccccaggaggggcgtgaggagaagcacctgccaggtccagctgtactgccctgggccggctgtggggagagggacatgggagcagaaggaggctgaggtgagctggaaccctggaccaggtcattaggtgggtgctcccaggaatggcctgggtcagacccctgtgggcgctccaggatggaacaggacattaccggaaacagcgacatcacatgtcccttcttggagggagccagtgggtgtggagagtggtgccctaggcagttaaggacatcccaggtacctccccatctcccacatgcacggccttttcaggagtcatttccaggatccaacatcctcacccgtatccttacatgctgacataccagggcccaagcctgttgcatgtgttggaagccagataaagttgatccaagaagattatttgatttttcaataaaccattatttaataaatatatcatgatctcccagtgggcgctaaggcttatcacgggcaccagtagttccaaacatggcattcaaaccttgctttgaggtgctcacgatctaataggggtatgtggctgggttagtagattctttctgcatggtttcagaagagccaaggtgtgtgtaggacacaaatgtacaattagaaacatgtttgtttccaagtgagaatagtttagccggacttaggtttaagggacacagctggaagcaggggctctggacccagccagcctggatatgagtcttggcgctgccacttcctagttgtgtgatcatgggcgagcttccaaactccttgtatctcagttccctcatctgtcaaacatgaatagcagtagcatgtacttcacgaagcacatataaggactgcatcaggtaatatctgtcaagcacataaacaatgcctggtacatagtaagtgtcatgggagtgtttattaaatcagcaactcctgacctcagtagtcactggtgtgtgtgcggcttcaggatccagtaagacagctcgtggaaggttggtaaaatatggccgaaacttgtcctccacggggctgtgaggaacttgaagcacttatcccactgcctggcacagtaaatgatctgtcaactgtgtacagttatcctcgtccttaaggcttcccctgatcctcgggtgctccagagggtgctgttgcatctgtcaaatgttcttactttctgcagcctcctagtgtccagtcctggtgaagccccttcacatcctgaatggcttctgccatcattgtgcagtgctgggcagcccggggtgggtcacaggcattttttcagtggagctctcaagtaacaggtgttttgatttcaaagctcagttcttatccaccacactggcttactgtgggatgcagaactattgctgtgacagcaataatagcatcctctcactagtactttacagtttattcagtgggccacagaggttatctcatttgctgaaacaagtaacaggacacagtaggcttgagattctggcttttgattgagcccaagtcaaattcctgaggagtctatttttagagttcccgacagcggacagggatggcccctgcccatggcttaagcctccaatagtggtgatatctcagggtctaacttccacttcattctgctgtcatttcggagcacagtagttacagtaatttttgaaaacagaaagcaaccaggatagccttgaagaagtaaccccatacgaagcagggggatgggggcttcgtactcctcccattgattccttgactagtcactagaaggaagctgaccccggaaaggaagtttcctacaactgagggccgtccatggagaggaccctggttatcggtcatcaacaaacaatacctttgggggaatgagcgcctcagttataaagcaaagatcttggtagcactataccatccactacagtccatcttctcttgcaacagttaaacctacatttttttctattttttttatttataatgttttgcggtacatagtagctgcatatatacttatggggcacatgggatattttgagacaggcatgcaatgcataatcacatcagggtaaatggaatatccatcacctcaagcatttatcctttcttcgtgttacacacatttcaattatactcttttttgttattaaaatgtacaataaattatggttgattgtagtcaccctgttgtatgatcaaatattagattcattcaatctaactatatttttgtactcattaaacatccttccccccccgccccactccactacccttctcagactctgttaaccatccttctactctgtctctatgagttcaattgttgccatttttggctcccacaaatcagtgagaatatgcaaagtttgtctttctgtgcctggcttattccacttaacataatgccctccagttccaccttgttgttgtgaatgacaggatctcattctttattattgctgaatagtactccattgcgtatatgtatcacattttcttattccattcatctgtggatggatgcttaggttgtttccaaatcttgggttttgtgaccagtgctgcaacaaacatgggagtgcagatatctcttcgatatcctgatttcctttcttttgggtatatgccaagcagtggattaaccctactttttcatgtagaaagttcacctcatttgagcacaactcctcaaggattctggtgatcccttactaaagaagttcacatgagaaagaagagtgtacaaacgataggccctctgtggcagctggcctctaagccacaactgatgataattctgttccttgtctactatccattctagagtactgtcggtttcaaccagaatctttgctgttctctattacttacccaatagagtagtgcaaaccctcatcccggaaggttctgggctcctggtcctccacgaccttctcaggctgtggcacttacaattgtccctatactatagaaatctggcaggggactacgaagacacattcaaggggtcactcgagagccaaacattcctctctgttcccattgtataagggcagccctacctcctcctgatgatcagagccaatatccctgcaagcatggcaactcctttttatgcttgctggtcctatagcatgagaagctcaaagtgcccagatgggagcaatagcttgaaatttaatggaaagagtcccattaaattgtttttttccaggtggaagtaatcttactttgggaaccaatatatctagccagcactgtccaatagggtaaccagcagccacatgtgaccattgagtatacaaacctggttagtgtgactgaggacctgaactttaaatttaattttaaatagtgtaaacttatgtgcaaatagctaaatgtggctagtgacaccttattggaaagcacagttctagaactacagaacctaaactcatgtagcagaaagtacaaattcccatacaggtcacagggagtgacagtaagtgaggtcattccaccctttggtatctgcatcatgtattctatctattgatggaagagaatggtaatagatttagggtatatacagtacagtagagaatgacaccccatcctcaaggctgtgatctccaaatttgcacctcatttgcactgtgaagaagccactccattattccagtagaccagtggcttttgggtggcgcagtatgagataacaactttagatcatacggtcatgtgcccactgagcacttcctttgctatatgtgggtcccttggtcccagctgatcgtatggagtatcctggctcagtgtatccaacattctttaagccctgtgttagtggtgcccgacaaagaaatgtgagcaggaaagtcaaacttatacctgtaatgtgtacaaattccagtaaagatgaatctctgctccttccaggatggaatttgctggacgcaatcaacaagccacaaggggctgattagtctccttaagtaatggtgccctactgggtattcagcactggcctctgttgctggcagtttgaacatttggcaaaaatagctggatatgcctgggtgaatggggacccatgctgttgaacacatgcatagcatccacttcttccaccgtggctattgcacacataaggccattgtgtagcattaatgtggccagcgactgaggctggctaatgtcaactagttaggtcatttttttcttgattaaacgtttagtgtctcttccatggtgaatgctctcttgagccttaagacgtgatacaaatatcttcacatatagtgtcccttctcatacgtccatcaataaacctccgtccccaatcctgcttattgcaatctgtcactacttctcattctaagtccctgagcagctgtccaatttatttttcactgtccataagtccattcgtagtttgggtcacttcttttttagatatgaagtggatcatcagatgcaccatttgaagctctgccacctggggatttctgctcaacaatgtatttcttgaccacatacgattgaggtagtattacaacagaagttcattttcaggttgcgctctaaatccggccaaaccatctattatctaagctcagcacttctactcctccagcagctggtcataagagaacttcctggtccattaatctataggaataaaaaagagctgaaggagagacacagacacaacagtggcagatgacattggggattaggtcacctgcttgtaatctatggccgtgctggtatctggtcctggatatgctacttctatcttatcacagattacttttggaatcacctgactttgtgggtctgacagaacctagctcatgatgatcagtagcgacatgccatgtgcctgaggccgtggtgatctgttctagtgaagataacaaatctgttaaaggctcttgccattgagcttgcagtagtgcaaagttgcagtagtcccagtgacccatcaggttcttgtaggagccaggctgctaccttaaattaagatatgatggggatcaccacccctacatcctttaggtattaagggtgtcattaacattttccatccctcaggatgcaatattgtttattacttactatcatggccaaggtgcaggaagtgcacttggccttctctactctgctagctcttctactaacagccacggacccagtcagggtttgtgcccattatcgaggaagtccatttcaatttcccatttggaaactggataaatgggcactctgggtcagacctaggcaagaactccatttattcctggcccacatttgcttccactctaacaaacagggggccatgatgaagcttcaggtcctaggtgtcagtgtcaatgcagattctgtgtccagcggtccttgaaatgtttgagtgttttcccccttcccagtgttcagttactgaggtgaatagacataggttcctttggaaactgggcttggaaaaccactattgtatcaacttgccatagtattgcaggtggtttcctcaagaggactctaccattgtgttatgttcagttaataaattctgtgtctgagaattggctcaggtctggaaactgggagatggattaaaactttattggagcagtttacccagcctactgcttattgagcctcgatttcatgtgggtatataagttaagcaacatacttgttgtctgttcttctatcttggctctaaaagcactgtgttctgttaacagagtctgctcctctctgcagatgagattccctgtttgccactcaagtttcctgcttattatgatcattgtgaccatcttgcttttgaaatttaagtgccacttccgtagtcaaaggggcaggtggcccaaagcttccagtttggggtgaaattgcaagaaatagagactctgtagacagcatctgcatagcaccaactccagaattcactgaccacaggtgatgctgtgggccctgacctcccatggcttcccagggtctggactaggggagaaagtataaatttcaccagagcgctattcatgaacacacatgcggcagctccagaaattaaaacaaaacaaaacaaaacaaaacaaaaaaaacaactgagtcatgtttacaagaggatagagaccccgtgtcatgcaggagtgagtgcagtcagtgaactctgaattgttaatgttaacccaacttggaagaaagaaagtgcaattgattttattcattgacatgatcctgtatgcagaaaattctaacaaacccaccaaaaagtattagaactattcaatgagtttagcaagttcacaagatacaaggtcagtacaaaaattagtagcatttctatatactaacaatgaataaacccaaagtgaaattaagaaaataattgcattaagaataaaatacttaggaagaaatctaacaaaatgagtgcacagcttatacactaaaaactaaacaacattcttgagaggagtgcaagggaatctgaatgagagagatgcatgcactgtgttcatgagtcaggagatgcaatattgttaagatgtcagttctttccaaaatgatgtgtagattctacatgatacctataaaaattccagcagatctttgtgtcgaacttgactagctagttctagaatttatattaaagtgcaaaagacccagaatagccacacgcattttggaaaaaaaaaaaaaaaagctggagaacatttacttgccgattcaagatatagtaatcatgactgtatggttttggtataggagtagacatacagatcaatgtaacagaattaaaagtctataaataagcccacatatccttgtgatcaactgatttttaacaaaggtgctaacatattaattccacgggggaaggaatagtcttttcaacgaatggcactgggaaaattgaatatccacctgcaaaaatatgaatttgcacctttatagcagaccttagaaaaattaactcataggagaaaatcttcattaccttggcttaggcaaagttttattaacatcagcaaagcacacttttgaaaaaaaatcaacaaattgtacttcatcaaaatttaaaactttttttactggaaaagtcacaattaagaaaatgggccagatttggtggctcatgcctgcaatcccagcacttgggaggctgaggcagatcgcttgagcccaggaattcgagaccaacctgaggcacatggtgaagcctcctttttactaaaaatacaaaaattaactcagcattgtgacacgcgcctgtagtcccagctccttgggaggcagaggtgggaggatccattgaatctgggaggttgaggttgaggctgcagtgagccatgtttgcaccactgcactccagcctgagcaacagagcaagactctattaaaaaaaaaaaaaaaaaaaaggaaacatacgtccatacaaagacttgtacaggaatgttcatcgaagcatattcacagtaactgaaaagttacaacaatccaaatgtccatcaactagtagatggataagcaacatatgctgcatctttgcaatgctgttcaacagtaaaaaggaaagggctacaggtacatggtacagcatggattaaacaaataagccatgtgatataattccttttatatgaaatttccagtaaaggcaaatcattaaagatagaaagaaagtggattagttgttgccatggagtgggctgggcacgtgaattaactataagtgggcataggaatcttattgtgtgatggaaatgttctaaaactaggactgtggtgatggttgcatgacctagtaactctagtaaaaaatcattgatttgtacatttcaaatgggtgaattttgtggtttgtaaattatacatcaataaagtttgaaaaaacccaacaacctaagactgggcaaccttgaagactttaactctcaagtttgtccacactgagcctccagcagttcatcagttacagtttaagttttctgcaccattactggctccaaaagtgatttctgtttctgggcttctgcttcagtaagctgtgattctctgtatccacctgtctagctctccagttttgggggcactgctttgctctgtgaccttagttctccgatgaatctgagaagagttactgatttctgctttgctcagtttctgttcttgttgtgaggatgagagtgatgacttctaagctccttatatgccagaccagaaaccagaaatttccaataaaaagatattttcttgtttaattttgaaaggtgatattaagcctctgcctggcacaacctctctggtcctccacaagcttaggccaactcaggaccccggtgtagccagccctggagggcctccacaccctgaagcatgagggacatgcctggagccagcagctttacagaagagctctggggagcaggtttctgggtgggggttatagaagctgtggctcagcatctgcagctggaagctaacaaagtgatgcattcatttgaggtattatcacagaatgggcttgtgtaccttgcagctgtcatcaaaaaccatcattcttccaacagtaacttgtccacaaaccgcatttcctctttgcctctggagctgcatgaactagtagtggactagatttttgcctggattctatctctacttgtgagcaagcgttttcctttagtggaaattcctttattcatagttgccaaaaattggaagcaaccaagaggtgctcaatacgtgaatgaattaataaacggtggtacttacagacaatgaaatgttatcaataaaaataagtcaggtcgggtacgatgagtcacacctggaatcccagcactttgggataccaaggtggaaggatcgtttgtggccaggaattcaagaccagcctgagcaatatactgagaccctgtctgtacaaaaatttaagaaaatagttgagcgtggtggtgtgtgcctgtagtcacagctactcaggaggctgaggcagaaggatttcttgagcccaggagttcaaggtttattatggacagtgagctgtgatggtaccactgcactccaacctgggtgacagagcaagacactgtctgtaaacaacaacgataaaaacaaacaaataaacaaacaaacaaaaaacccacggaggaacctagtgaagaagccggtctgagaggacaacatattgtgtgattccaactgcatgactttctagaaaaggcaagctggagagacagttacaaagatcagtggttaccagagttttggaggcagcaagggagggataaataggtgaagcacacatattcattgggtggtgaaactgtaatggtggatacacaatattatgcatttgtcaaaacccaaagatccttgcaacacaaagagtgaaccttcatgtaaactacggactttagttaaaaacaatgtatcaataatgatactagttcattaattgtgaaaaatgtagcatactagcagaggataataatagagaaaactttgtacaggggacaaaaggagtatatgggaaacgtactatctcctcaattttctaccagtccaaaatttttctaataataaagcctattcattaaaaaacaactagaactaaatatacaactaacaaacaacccagcaatcacacacctgggaatttattttagaaaactaacaacttatattcacacgaaatcctgtacaagaatgttcactgcagctttattaataagcaagtactggaaacagcccagatgtccctcaacagactaatggtttaaaagacaactgctggccgggtgcgatggctcgcacctgtaatcctagcactttgagaggccgaggcgggtggatgacctgaggtcaggagtttgagacctgcctggccaacatgacgaaaccccgtctctactaaaaatttaaaattagccgggcatggtggcgggtacctacaatcccagctatttgggaggctgaggcagaagaatcagttgaacccggcggggagcggagattgcaatgagctgagatcacgccacttcactccagcctgggtgaaagagcgaaactccatctcgaacaaacaaacaaacaaaacctgtggttcatccaggtcccttggaatactactcagcaatgaaaagaaatagactgttcatacacacaataagctggatgaatcgccagacagtcatgccagatttttaaaaagccagtaccaaaagcttacataattgtatgactgcattcaaataacattcttgaaatgataaaatgataaaaatacagaacagatgagtggtgtttctaggggttgaggaggagaaggtggtgtaggaagaaagtggctgtggctataaaagggcaacatgagggacccttgtggtgactgttctatgtcttgactgtatcaagttaatatcctaattgtgatactgtactacacttttgcaagatgttatcattagaggaaggtacataaagggtgcacagggtctatctgtattatttcttacaactgcatgtgagtctacaattgtctcaaataaaaattgaacttgaataataatatgtagacaatgctcccctttattgcctgcacgggggaggagccactcccacaccccatccttggtagccaactgctccattccaaaggtattttttaagcgagagtgttgctgaatcagtgttggattttcaatgtccaaacaccattaatttagtgcttcagagtgctgttcatgatttttagtaggaaggtttttggtttttatgagggcaattactttgtgtgccttttatggggggcgacgctggaaccatacacataactcctctccccagctgggtccacagccctgcaagcacacacggatataccaaccttttcctcttctcccatgggccaatgtgttaaggaggaaatttgtctccagaattcagccccgacccaatccttctcctatgtgcttggctaactgtgaatcaacctggctggggttgcccatgtgaccccaaccgggcaacacccacctccatctcttcccacacactacctcttccctccttcctctctccccaccatcggagaacatgtagacacacatatcagtttacaacagactcatttagttttcttttttgatttagatttattgttattgataaggtttataataacaaattaaatatttaaaatcaaaggccaattattaggtctcatttagttgcttatttcatttacttttatttaccttcccctagtgtctgaataactatcaagaaacaagtcaaacctgtgaaaatacctgttaacattcaacatatatttttatatatttctgttctatgagtcatttaattttcatcaccatggagcatgccctgctgggtataaaatgtaccctagaccttgttggctatttctctggggactagacctctggtgactttgcagatagatctcaggtctctggtattgccctgaaattactggctgcccaggggacacactggagatggttttggtcccgctgtggctcgttttgattgagctcctcattcagctggtcacggtggcctggtagtgttggcctactcccttcctggagttttcctcaagcagtggtcattttgggagaggcttcttttctggaacgccatcaaagtgtttcttttcccttgctggtttgggaacctgaaaggacaacaaggagatcacagaaaggcattggttttggggaagtggatggaggagggatggaaagacgggtttcatgagaagggatacaggctggggtggggggttgtgtcaggccaggatagggtagaagtcttgggagggaggagtcaaggggaagacgaggaggagcttgggtgggttcctcaccttgatagggcttctggaccttgattgagaaggggtcttcctcctcctcgcctctttggtgttggcaggtggttgttccacaactgggctggaggcttatggtttcttggccatcttcaccttgtcctcgtctctcaatggtctactccaggccacctggcctccccatatatacccctcccaggacaatgacgaaccacatccctaagctttgactagtcagagagccactacccatccagtggtggctctggaaggcttaaatatacaaagcaccaacctgacacctctgtggtgatggtgggggaggggtggcagtgagggggccaagatgctctggttggagaaacgtagcatttcattagcaaccctatacagccatccaaactaacctgctaccctctccatctccccatattaagttctggtgggtcacatcgtggggagagagtgttccctccaagccttcccccatggccacctcattgagtggctcactccattctctcctacccttcacgattatctaatttttgtacatcttaccaaaaatccctccaaggtaatatggccgatttagctgtatgcagagatgtgaatcatcccacttccctcctaaaaatttatcctatgtaacttgaagaccactcacttcttggttactgtcagggaaaagttccatcccgcattcttttcctagtgtccatagaggtcccttcagttttctgttttccaatctgaaatcgctgccttcaggctgtcaggctctcatgctgtaaacagccttgttctactgagtatcttattagtcttgtttcaactatgggcattgtgttcatctcagtctgtgtagtaccagatttgggttttaacaggagggatgagggagatattcatttgccagaagttgtgcggggtgtttgcatgcaggaaactacaacctaagacatttgagttcacagaggtggagtggttgttcaacattatacttgttgctcagtgcaacgaagagagaaaaagacctccagattggaaagggaaaagcaaaaccgtctttagtctatgcagaaacctgtacaaatctaaaataaaaatgcttctagaactaataattgaatttggcatggtcacaagataaaatatcaatacacaaaaattaattctattttatatactagcaatgagaaattggaaattgaaattaaaaacagtatgatttaaaagtaacactaggccaggcgtgaaggatcacacctgcaatcccagcactttgggaggccgaggcaggcggattacctgaagtcaggagttcgagaacaacctggccgacgtggtgaaaccccgtctctatgaaaaatacaaaaattagcagtgtgtggtggcgggcacctgtaatcccagctacatgggaggctgaggctggaggatcatttgaacctgggagatggaggttgcagtgagccgagacctcgccactgcactccagcctgggcagcaagagcgaaactccgtctcaaaataaaataataaaataaaagtaacactagaaaacatgaaatacatagacataactatgatgaaatatgtagaagatctgtacaccaaaaactaagaaatattgcagtgataaattaatgaaggataaatgcctaaataaagtttattttggtatttgtctcctaaataaatggagatagctatcttattcatgagttggaagacttactactgttaagatgtacattctttccaaattcatatatagattcaataaaatccatatcaaaaacctgaaagacttttttaaaaatagaaattgacaggctggtgttcacattcatgtataagtacaaagaacttagagtagccaaaataacttttaaaaagacaacaacacgtgtatacctgtgtaagaaacctgcacgttctgcacatgtatcccagaacttaaagtgtaataagttaaaaaaaaaagacaacaaaagttgcatgggttacactacttaatttcaaggcttattataaagtcacaataatcagaagagtgtagtattgtcataacaatagaaatgtgtcaatggaactaaagagagagtctagaaatatattcacgtatatgtatttatagagaattccttattgatttgaatagacagttctcaaaagaagacatacatatagcaaacaagcatgtaacaagtgctctgcctgtttgatcatcagagaaatgcaaatcaaagctacagtgagatatcatctcaccccagttagaatggcttatatccaaaagacagcaacaacaaatgtttgcaaggatgtagagaacagagaactcccatacactgttggtgggaatgtaaattagtataaccactatgaagaacagtttgaagggtcctccaaaaactaaaaatagagctaccatatgatccagcaatcccattgctgagcatatactcaaaagaaaggaaatcagtatatcaaagagatatctgtattcccatgtttgttacagcactattcaaaacagccaagattcggaagcaacctaaatttccatcaacagatgaatggctaaataaaatatggtacatatacacaatggagtgctactcagccatcaaaaagaatgagattctatcatttgcaacaacatggatggaactggagatcattttgttaagtcacaacagggtgactatggtcaatagtttttagttattttaaaataactaaaagaacataattgaattgtctgtaacacaaagagtaaatgcttgaggggatgggtaccccatttcacatgatgtgattattacacatttcatgcctgtatcaaaacatctcatgtacttatgagatgtacaactactatgtacccacaaaagtaagaattctttaaaaatgacacataaaatgttttaaaaatgctattcccacaattgattttccttgtcaaatattaatggtacccattttagtctaaacatccttgataaaagaaaaaacataggaagactcacacttcctgatttcaaaatttatgacaaagcaactggtcaagacagtagtggtacaaggatagaagtatagatccatgaaatagaattgagagtccagaaataaactcatgtctctggggacaactgattttaataagggtgtcaagagaacccaatgggggaaagaatgatcttttcaacaaatggtgctggggcagctagataagcacatacaaaagaatgaagtttgaccttacctcacagtatatacaaaaattaactcaaaatgaacaaaagacctaaatataagagctattactataaaatttgcagaaaacaacataggggtatatcttcatgaccttagattaggcaaataattcctagatatgacaccaaaagcatgaacagaaaaaaaatagataaattggacttcacaaagattttaaacttttgggcttcaaaggacaccatcaagacagtgaaatgccaacccagctgatgattgttcttctcagatttctcaaaactactcctgtacattgtcgtatactccctccccctctggcttctttcccctgggttccagggtccctgtccctagtgggctgaactctggattcagagctctgagtgccagcctgcctggggctctgtggacttggttttgcatgtggtctcactcatgaactctgacaattgctctcccctggatccacccaatgcccctcacgggctgagcatgtcctgtctgctctccttccgtgcctcctggtcagtctgactgaatcttttttcctcaaatgaaaaacatatgttgacatttcaaaattttaaattttaaatcatgcccagaggaatagtcttacttagaacactgcataaatccagcttcgtatgggtaagaaattaacttagtgttctaattaacctagctagaaaatgcagagacacaaattaaagtaacattgagaaaatatttttcactcatatttttgatcaaaattttaaaattaatatagtaaaatgttcacgagagtataaaatgtccacatacattaatgccagatctgactggcagacgctgaccgagcgatggataaaaaatgtactcagacacaggtatccagtgaaagagaaggctaggggactgggccattcacataaagagttgtagcagccatggccccaacaagccggcactgcgggcaaatattcactacagatttaatgacaaaggctttgagtcaacacatcttgtgggtaattaacatggccgccccccagagagagcagtcctgcacacagatggttaaaggccaggtttcgggcctaagtaaactaactgatctagatcaattcctttacacttccttgttatctgctttttgctctctggctttggataagagactttggctgccttcagccaaatttttgaagcttttgcaaaacctcctggccttccaaggcttgtgtttttcctataattccttcttataatttctcccaccaccctgacctatctcttacatctcccccttttctgtttttttgcatcagattttgttgattgaagagcacagatgtgtacagcaacatgtttgtctggcacagcggttataactcatattctggctttgaatcctagaattagtaaataacataaggcaaacatgagtataattcacaacgttcttttccaatcaaggagtgacccccaggagtggggatctatccaggagagatgttctctcatacccttccgtatggctatttgttgggcttgtaggtctatggcgtttagggattctagaattttagttttaagttgctttacgtctgctgttaaattatcacgaaaggttccccagaggtgctgtttcaccttatcccaactatgtattgattgattccaaggtagagaggtaacacagatgtgcctaagctcccagtcacagtttaattgctgttggaacgcaagtgcatcttgttgctcccctacatattccaagtcagcctcaagggcttgcagatgtgcaagaatcttttgatctataccctgctgtaagagaagtacatcagacacatttctggccaaattatctacaaaagtagctgtctgtactgattcagtaatagatgctacagcaacactagcagttgctaggatgactatggctgagaccataaaggctataagtgtaactataaatcttttgcgtctgacctgggacagggcacattctaaggtggcaagggcagaggaaccttgccaattgcatgttaaattgaccggtaggaaagcctcagattgtctcctcaataccatgacactagcaatatttaaattagatatattataattagtgatacaagagatgaaccaagcctgtccctgcattcgagtcacaaacgtggagttttggggtgtaatagaaatattggttcccataaggaaaacatatggatgggtagtgcaaatcaggcaaatcaggcactgatcggtgtgattatgaaaaaaggtcatagtataattgtgactggaattatgatatgtcccatgccaggtgttaagggaagtgctaagatgtcccaggtgccataaagtgtcttggggtggcatggactctacttggggtctgggatatccctccccccatcggcccaaattataggggaacgggatgtggctacaaaactgccattgatgccaagatagacatggacatcaatacgatcgccctgcaaatggctgggaggactccagtctaagatgttataattgcttaactggaggctacaggcctgttccccgtgacagacctcccagctaaagtggaatccattactttcccagctttgttctttagcacagggaggaatgtttgggaaaatggcattgattgcattgcctggtttgaggctacctgctactaagactgttaaagcatttcctttgccacaatgtagccaaaattgtgtttgagcaggtacacagtaagggttagaacttttataacttacacacagtgggaggatagtggagtgatatgtagtgttacctggcaccttagtccactgtgtgccattaatgagggaccccactaggggtaaatctatctctcccagccaagcagttatgttattagaggctgggaagggggtgtctgcccaggtgatggggcagaagaagggcagatctaagcgatgagtccaatagagtgcagcaggtgcagattgcagacaaagcgagagcataaaaaggatcaatgccctacatgagttgcaatgtacaacagagagcatagcaaggaacaaattatctggagtgaatggtgtctgtgtccggagcaggattcgctcggcctcctgagttgtcttcttcagcatcccccaggtaatgtctggggcttgtgtcatccgaggaagcagtattgtctggggctgcgggtcctgcagggtcattttcttcatttctggtatgggttgggtcctagtcatgccatggtatggtttgatgcatcctgctggaatccaaagaggatctgagggggtgtgaacacaagcatatcctttcccccatttaagcaattcatttggaccataccatacattactgtttacaactttctgtaaaacagcaggttttatgtcttgagaggttttagcaaagtgcttttctacagctgatggaaatttatctttaaatttaaaaaattaagggtaaataaggcttgtgccaatagtgttgcagtgtccttaactcatattcccccttttttgtttttttgagcatatttttaaaggtgaaatggacacgttctactatggcctgtccttggggggttatgcgggatgcctgtggaatgttggatgttccacatgtgacaaaattgttgaagctgtgagctggcataagccagaccgttatcagttttattctttgtgggccgccccataaatgcaaaagttaaaagaagatgtttaatgacatatcgggtggactctccaggaaaggcatgagcactaattacatgagaattggtatcaatggacacatgtacatatcttagttttccaaattcagggatgtgtctaacatctgtttgccataactgattaggttctagtcctctagggttaacacctgtagaaggaggggatgtgcctgtgagctggcaatctgggcattgcaggataatttgtctagctactctctggataagttgaaatcgtttggataagtttctccaattttggtgggaaaattgatgttattgggtggattggttaagccgtgatgtcaccacttgtaggtctgcttgttcattgtcataagccagtgggccaggcagtgagctgtgggctcgaatatatgtgataaaaataggatgtgtacgttgatctagcaattgctgaagtcgaacaaaaagtgcacacagtgtgggctccagagtggacttaatgagggttgtttcaaggttctgcagtaaataaatagagtaagcagggtcactaacaatattgatgggttgagcgaaaaaattctcgaaggccaatattaaggctccaacttcagctctctgagtgctagtaaatccagaatgaatgagggaattatgcggtctccaccaaatagccgcttttccatgtttaccagagccatcggtaaacagtgttaaaatgttaggtatgggggagtgagctatttttgcaggcaaaaccacagaagtatgagataagaactgaagtcatttatcagcaggaagggcatgctctacatggcctgtgtaatcagagagtgctgtttgcaggcctaaagataaaggcaatactgcttcgaattgctttttactcaaaggaattctgatgacatcaggatcataacctagcaacctattgcattgtctgcggcctgaatggatgactttactaattagctggatatatagagagagtgttttagtcctattatgtgggcaaaaaacccattctagaaagtgcagccctgggcccatctgtcctattaatcctcttggggaatgtttagtgggaaaaacaaacaactgaactgaatatcatggagctatgcaatctagttgcctgtgagaaatagcttgctctactccctcaatttccctttatgctgcaggagttaagtgcctagaagagtctagagcagcattgccttttaatatagaaaacaggttttggaacttataagtagttatgcctaaggtggggcgaagccagttaatattgcctagtaatttctggtcattatttaaggtgtgtaagttgctagtatttaatttaaccttttgaggttttgctgaccgggaagttagtatgtgcccaaggtatttcctaggagaggacatttgtactttttcaggtgctatgattgaacctcttaactgcgtgttctttacgacagaggaatataaacttaaaagtactggctctgttggggctgctggtaaaatattatccacaaaatgaataatcttgcaattaggaaattattttctactggggagcaaagcttgatttacatgttactgacacatggtaggactgttcagcattcctggaggaagcactttccaatgaaatctgcaagctggcctttcattattgatagctggtattgtaaacgcaaatttttctctgccctgttttgcaaggggaatagtacaaaagcactcttttaagtcaataacaactgtaggccaatcttgaggaatcgccgtgggggaagggagcccctgttgaaggggccccataggttacaaattagcattaatagcacataagtcatgcaaaagtctccatttaccagactttttgggaatgacaaaaatgggcaaattctaagggctatttgatggttctatatggctggcttttaattgctcctcaactagttcatgggctctttgtaatttctctccctttaaaggccactgttctacccaaactggatctagagagagacacgtgaggggtaggggaagaattacaacagtggccattattagaaaggggtctgtagagtgatccccacattgggctaataggtcccgcccccaaagattaacagggatggacatgattagaggttgtataactgtttttcttccctccaaatcgcaacatattagggggcgtgtgctctgcttggctgtgtgcgcttccccgatgccgacaatttttcgtttctgagtgaccgaaggccaagtttctggccagttttgatcgctaatgattgaaatatccacctctgtgtccaataagctagtaacatttttatttccaatttttaaggtaatcatgggtctctgataagcgattaattggttccaatatactcctgtggctcccgtgcttccaaaacttccctttcccctttcttttccctgggctttggggacccagtatggtaagagtattaactgggctatctttgatccagggagaagaatatgcagacctttacgttccatcataactaatatttcactttgataatcactatcaattactcaagtgagcacattaatcccttgactggatagccttgattgccctaggactaatcccactgttcccggaggcagtgggccccagatcctggttgcaacccttttagggtcttctctttcttttagcactaattcgttggggcagagttaagtccagtcctgcgctcccagtggtggctgctctgagagagaggactgtgggctttccatctgactgaagaaagccgctggcattgcccgtttggagcggggcctggggctggcccctcatgaagtttcccgcctgattacttagggggttgctgtttttatcaaatttggaccctcactgatttgcccaatgtttcccctttttatatcagtggcatatagaagggggttcttttcctgaattaccttgctctctactactggggcattcctgcttcatatggcctggctctccacatagaaaacaatttgggtttctctcctttttcactttaggaggccttaatgccatagccaatatttttgctttgtgtgtttcagtccccaccagttgacacgcttgtataagttccccaactatggctgcctttcctctgattgcctgcattgcttgctggcagtcgatgttagcattttcataagccaattgcaacaataagataacagcggcctgggcatgactaatttgtcttttaattgcctgggttaaccgattgataaattcaacaaatggctcctgaggcccttgtcaaacatttataaaagatccctgttgaactctgctctcgggaattcagtcccaagccctgagagtgcacaaagacacttgtgcataggcctggggatcaaaatttagttgttgttgtgcatcagcatggggacccctcgcctggagcatagcagctgttatgttttgcccggccaattgattctggttggcttgttgttcgcatattctgccctccagaggaggtattggctgggccccaaagttgttttagctagcactgaccagtcccatggggtcatacagaagttgtctgacatggcttcaattattccttttgcaaatgggctagtggctctgttttctttaatgctttttcttatctctttataagcattaaaagaaatgggttcatatacccgattgccttgttgattttgcattaccaggcaggccaagagctccccttcaaatgccacttgcctaagatagggtcctatagctgtagcgtatcccttgtcttttttccaatttattggaggagagggcttaggcaaaacctctttggtacatttgcccagaaacagccgggctgagggagatagaagtggtaaggtaggtgatggttcctcctccctcccctttttaggctcttctgtgtatagcgggaccaaagcaaccctaactaaagcccataacgttagagatgttactgggacccgctgcccttgtgcatgatgttgtttaggatttctcccaacttgttcccagagctctacgtctagcgtaccttcttccgggaaccatgggttatgggaagcaacagtttgcattaggtcccttaactgagcctgcgaaactgaggctctgctagctttaagcagctgtttcaatacttttatatactgttgctgttgcgctgatacctgttgtccgatgatgaaaccctagcctgaacaattccttcgaacttagaaatcccgagcgggcacctatgacttattgacttaatgactgcgcagtctcttcaccttcgttttcgagggttccgttgtgatccgttgcagtgttcctcacacggggcaccacctgccgggtctgaccggcagaccctgaccaagcgacagatgaaaaaatgtactcacacacaggtatccagtgaaacagggggctaggggactgggctgttcacagaaagagttgtagcagcctcggccccaacaagccagcgctgcaggcaagtattcagtacagatcctttgagtcaatacatcttgtgggtaattaacatggttgccccccacagagagagcagtcctgtgcatggatgattaaagaccaggttctgaggcctaagtaaactagcttatctagatcaatttatttacacttccttcttatctcccttttgctctcaggctctggataagagactttggcggccttcagccaaattatctttcgaagcttttgcaaaacctcctggccttccaagaaggtttgtgtttttcctataactccttcttataatttctctcactaccctgactgatctcctacacattaatctgtgagaacatgaattgcttcagattttggattgaaaggtctgcaatatttataaaactgtaaactgtttccaccctttcctctttaacctcatgttcacattgttaagtatttcttagtaaaaaaaatgcacatttgcacaataattcatgttcaatgatgttgattttagttctattaatcataacaagtagagaacaatttatttatctgtcaggtatagaatggtttaattgattatggcatattaatgctttaagattctagagagtggttacaaaatcgagggagatacatacatactgtcatggtaagattctgtatccattttattaagtggtaaaggcaagtagcatatcaatatatacatcattatcaaaatgaccaatatgctagtatttgcatagcacatctatatataagaagcctaaaatcagctttaaaataatacatatcagattaataattatggtgaactctgtgatggggcttaaattgtggaaggactttggaaagggagaaattacaatatatctgtatatttagattgtttgcaacaagaatacatatacacactgctatttttgtgatgagactctttaaataagaaaagcagcaaaaatagttgctgtgtattagtcagtaaaaataaccgctagttgatgcaacagacaaaccctaaaatttgaatggattgacacaagaaaagtttattttatgtgcccataagttctgatgcggtttggcaggggctctccactctcacatgacccagggatccaggctgcttccaccttgtgattccatcatctcaaaatgaaactgccatgtttactgttggatggaggaagaaaacttggaaatggcacactggttctcaaatgcctggatgtgacaaacaacacttctgctcatgtttcagtggtaacaagtggtcacatgacccttcctaactgcaagtgggctgtactgttcccatgtgtccgggaaggagacaaagacaaaatgtgagtgagtggtatagtctcccccataaactgttatgtaggaggtgctcaaaaaaagcaattatgataatttggtattacacaacccttgtcattgctagagtttctgagaagcccacatttgccttgaagttctctaacattttcaagtgcctgctacgtgactgatgctttgaaatgtaagatcacaactgtccaagaactttgaaagtctcagcaggaaggctcatcagggaatcttccctttataataccctttaaacaattagtaggctttgaacttttcctccatttgattcctggtcaaaattttaacctgtgagtttctgctacccttcacatgcctaaacacctgtcaggtgcctttagacacaatgaaagcacatattttcctgtggggcaagtactagacaagagaaagtagaaacttggttaattattctactaaaatttgagctagtactcccaccaaggcagcatttttcacctcctgggagactctggggttttagttcagcctcagtagatgttgactccacagtgatttccatgttctttcctcatctccagcttatgcgagagagtttagattttcaccaccaaggtaaggtcattcatccttgtatgtgttcagtgaccagtttcaaataaaacaccccattaaattcctattacgaataacaaaatggctttaaaaaactctctctctgtaacttcgtatctcaagaatagtatatcatgtgctaatcacattccactcaccatctatttagaaaagttcgagggtgtatttagacacacagttgggatgacaggatgtgtaaaggggaaggcaggtgattccgcttagccttcacagcaagcagcagggaggagcaggaagcaggccagattccaattggaagaaagggcacatgagggagaccaagggaaggcctctgtggcgcgagaaagtgttagggttggacagaaattcctgcacttgggtagagtcagctctcaggaaccctagggctcaggcaggaggaccctaggttaataaagcccacagactatccccagattatgtttcattctcattgtcaccttccttttgtaggcccgctttcagtaccacgtccacagtgtccttcttttggccacttgagagacattatgcagtactgagaaaacaaatgaattaagggacagaggtgtacttcaggctgcaaagagtgagaatagaatgggctctagatgaattcaggccaaccttgtggtttaccagtgatatgatcttgggaaagttaccaagcaccatgagactcaggttcatccagaaaatgggtttgatagaccatttttttaggactgttgtaatgtataaaatgtattaaaacacctgggatgatgcctggcatgtactggatatttaatgattgacagctatttctagtattactgtgaccccaggtgctaccactctctactttggaatattttttattgtccaggacatctcagagaatctgcaactcagtaggaaactgcatttccttggtgaatatgtatgtggggggaggggggtgtacatgtgtgtatgggtgtgtactttcatagaacaacagattaatatggataagaagacaagaattaatgaccttctccttttatttctctgtttcacaacaccagttcagctttattgttaagttcttacattctccaagaaaatacctattgcaaatcacagcaagatggaagatttcccaaaatgttttacaaaatggcaaacacttgcacttgaaatggataagcaaaacaacatgtgtggtcagtatcatccatacacttagatgttgaagctaactaaaacttttattacaggaacaatatttgaaaattaccaaagggaaacaaaaagaaatctccaagtcacccgatggaagagaaacctaaaggcagtatacaatgtgttcccttccattcactgtgccttctactactgagaacactgacttctctcatcaaacacagagggaagaatgggcctgatttcacacaggacagggaaactgctgggtgtggccctgaagcatgcattggcccatttccctgcccgctggccctggttgcatctcatgctcagactccctctccctcctctctcaaagcatcttcatacagggatgggtaagaagtgggatccctcccattggcattggctatgtactcaagaactttcatcttgctggtctcagcgtgggcccttggaccccacaggaactcatagcatgcaggatcagtgccgggcacctgccggtacaccaggtacttttcctgcacccaattttgggtaaggagcctcttgggctccccaaagaggaagtgctcccttccagcatacacccccataatgctcaggacttcccacataacctcttcagggatgcagttcccctccatgaagattacacccaggactattatcaggaggccagacttgggcatgctctgctcattacactgtatgccatcataagagaggttgagggaggtgacaaggacataggagtggctagtggggtccacttccttcacatcaatgccaaagagcagttgcatgcatacagaggcttccctaaatatctcaggaaagtagtcctcataatttttgatgacactccccagcatttctgcctttgtgatcagccccttgactcgatacttgcggagcaataaatgaaccaaatcaattatcttgtcatgtagtatatcttgggaaaaggactcagggtctatcaggtcaggcgaggtacttggcccctccttttcttggctgccagagccctcatcagataggctcccaaagatggcatccatggcagtgggagagaaggactcttcctgaggactctggggaggacttggtgactcagcagcaggcaactcctctagagtgcccacattcagagtagaggagaagaaggcagcctcctgctcctcagcttggagagcctgtgcacccaccaggcccaggtcttcttcttgggcctgaaggccttcctcaggcttgcagtgctgacttctttgctcaagaggcatgatgactctggttaggtcagcaggccgaactgtgggaaatatctgggtgatggggccccacagcctggggagagagggagcgtgagaacagactcagatgagatatgaaccatggagaatctaacaaaggcctacttacacttgttctcctccagtgatcctctgggttctcctgggactcctgtcctccaggttggcctgttctctaaaaacctgaaaaaggaagtgagaaggctgctcaagatgcagctggacatcagagcaggaggctccaggactgaggtagggcaggtgaggttgcaagctgggggtccctttctgtactggggcaggtggggccatttgtagattaagggtgaacatctcatcttgactactggcactgcctaggcttcctgtgttctgagatctgaagacattgcttgagaccaaggcctcactgctcagtttttggagcttctagaagaggaatcatggggccatcaggctgcagactgcaagcacccatcctggcaccccagcactgtcagaaaggtgggccaaactctgtgagtttctcacttttttggagtggatggtcccctctgtgctcagggccctcacctttctcctgccagggcctggaagacacagctctcctgacctgagaaactctcagatcaatagctctttcctgatatgaaagaggacatgtggggatacacatctggccacatgtacacagggctacccaggaaggacagcaagagatggtgacagtcagcagggtccatgtgtcctcgggtaaggagcctgtttggttcccatcttgatgcctatcttggcctgggaccctccctctgttgacctgacgccatctccttaaaccaaagctctacctccaggagatatcagaagaggaaatcagggaaatagaaacacccatggtcccagggacttcccatagctgacagaaggggcagggaagggctgagtcccatgtttttggtaagtgctgtcccgtcagcccccaccttgattctggtcatggcctgggaccctcccactgctgacctaagtgcagccctctcagaccaatgtctcccgctccctgagaccaatgatcccagtataagagaggggtctcagcacatagtcctgcacatgctctctggggagacagcaggggcagagcagatttctaagcagccctctgtgttctggccaggaggaaccctcaatcctccctcaggtttctcacctggactcttggcagatcctgggaccactgtagttgtggaccatatggggctctttctgttgactggaagtcgtcctctgagaacatagtgctcacctgcccaagattccaaaacagaagtaaggggccccacgtcccatcaccccatcatgtggttgtccagggctgacagcagaggctggacccttcggttctggggattccaaagtcctcctgtgggtttttcatctttacttctgccagggcctgtccttccttgactcccaacccctgagatgagcagacatatccctttacaccaagacctcatctccctgaaggtttcccaactttctgcctgtggtacaagtgaccttgccacttggggccacccgtgatgaggtccccacacagccaaggacaggggacagagagactctgtgggatcccttcattatgggatgtgggtatctccagtcctcaccaaggggacacatacaccttgagtcctaaagatcctgggactcctccctctgctgatcaggtgtggctccacctgctgacctgtcatcacccccttgaaacaaggtgctcacctccctgagcaaggtgccacccccaacctcgtggcagaaatgtgagcatggcacatgcctccccaacttgggcctccgagggatgaaaacagaggaagcaaggattggtgaggtccctttttctttggcatgtgggagggtacattcttaccttcagtcttcatcaattttcctctccttgactactggcagatcctggactccaccctgtgctgaccaggtgtgtatccctctgctgacctgaggacctgcctcagaccaagggccccacctctctgagatatgggaggcagaaagtgaaggggcactacatggacacccctcatgggatgccaaaggctgacagatgaagcagatttcaggggtgcctcctctctctgggtttcctccaggtattcagatttactcctgacaaggcctatccatgtctctcctgctgaactgtggatgagttttgcaggccacgaccaccatctcccagagaaccccaactaggaagtggggagctgcctctctttcctagagtcctgcttggggcctccaaggaccgatggcaggggcaggttttctacctcagggataattggttgcctgagtcctccctctgggactcctccctgggttgacctgaggctccactcctcagaccacaacccactccttgctgacaccccaaaggcagagtgaggatgcaccacatgtggccaccgtgccttggaactccaagggccaaggtccctactgacctggagtccaaagtctcctgagtcctccctcttcttcttcctcttgatgctggcagggctgcaccccagaccccctctgcggaactgagtctccatccctcagattcccaaggctgaatgaaaaggcacctcagtttgagacggcgggactatgggggggggctgttctggggtgctgggtcccttcagttgtccctcaggccttgctcacctcccagcagggactgagccctgtctgtgctccccctaggtctttctcatgataccaagccccttccctctgtcagcccaggatgcggaaatcaggatccacttgcctggcagcaatgccaggaacttcccaggactgacagcagagagggagccttgctctgtggggcctcagccctccctcggggtcctgaccttgatgcctggcagaacctgggtcctgccccccccaaccagccctgccctggtcacaccaagctctgaccccacagtcccctgaggcttaagcggcggggggcagaagccgaggggggtgtcagaggggacggcccagcctgagaagtccatccccatggggtgatccagggctggcagcagaggcggtgctggattatctggggtcctctatctgggtagggagcatcctcagtcctccctcagcatctcatcttgcctcctcacagagcctgggcccgctgccctcagcaggtcacaagccgcccttcagaaccgggctatcacttctctctgaccccctaatgtgcaactccgcagtaccaagcccggaggtcctttgcgttgtctgcagggacaaggatggactttgtggcccctctatcaggatggggtggaacctctccataatttctcagagtcctgatgttgatgcctggaaaggccggggccccaccctttatggaactgcctctgcccgggtcacaccatagactcgcagagtctccttgggcattgaggagggggattgtctcagcctgataatttggtcccctgttgtttcagggctggctccagggttggcgctggattatttggggccctctatctgggtaggaggactcctcagtcctccctcagctctcaccttgcctcctcatggagcctggacccgctgccctctgccactctcaagacacccctcagaaagacgctttcgcttctctcagatcccagaggcggaagccaatggaggtcacatccggcccccacgcctggagcttccctggatttacagcaggagcgaacccgattctgcccgtgtgggggcggggcgaggcgaggcggggcggggcgaggcgaggcggggcggggcggggtggggcagggggaaaagtagtggcgaggggtgcagatgtggtcgagggtcatgggggtgcctcagtcctccctcaggtttctgaccttgattccttgcagagcctggagctccgtcctctgccaatgatgtctgctcctctcggaccaagtctctgactctgagtcccctgaggtggcagtgagcgggaggtgtgaggtcgggggacaacattgccaaggtcttccggggctgacaggagggaccgagctggattctgtggcccctctatgtggggagggtggaccgtcagtcctcactcaggagggtcctcctcttggctactggttctttcatgaagtgatgggtgggagatgctctgtttctgtcacctctgagcattgcccaactgcaccccttgcagacaatagctgcggatcccaggctaggtgcttccatgtggcttcagtacccgtgattgtagtgacctctgggagaagatgcacaccttcctacgggggctcctccccagccagatctagactttgcaaacttttgccctgaaagctttatttttacactgaagaggctgagtggctgcaagaaatttgcggaagtcctgcgtttagaatttatctaacacttcatagttcattttagtgattttcattttttaattctcattcagtgtcaaaaatcatacttaacctaactgcctatttcactctaatggtcaatactctaatttaatccattctttatcttcaattaaaacgataatttttaaaaagccaatctttatttactgacgtggttttagtggttatcagcacaaattccagccgtattcctttaatcaaccagtgtttcctcatgtcctgaagttaccccatgactactggcacctgtggtctgagaccctacccgagttttccacagtgaagtaggggcagaattttaaacatttctttcttcctatccaccccaacttccctgccactcttccccgccaatcacaagtattccttcaaaatacaatgaaattctcagggctctctcatgttttttttgtttagatttcttttttgatattgtttgcttgttcctttatttatttatttttattctttagttttcccgggttgttttggggagtctaagatagaagcccaagactgaacgcggtggttcacacctgtaatccaaacactttggtaggccaaggcaggaggatcacttgagcccagtagctcaagattaatctgaactacataacaagaccccatctcaaaaaaaaaagaaagaaagaaaaagaaaaagaaaaaagaaatgaaaaattagctgggtgtggtggcgtgtgactgcagtcccagctggtagggaggctaaggtgggaggatcactggagcccaggatgtcagtgctgcagtgagctgtgttcacaccactgcactccagccttggaaatagagtgaggtcctgtctcaaaaaaacaaaaccaaaccaaacaatcaaaaaccaacagatgcctgagcttgacagtcatcttggctggttaaggaattacgtctgtcaatttttgaaaaaatagaattgccatctttgcaatattctgttccctatcaatgatatcatatactgccttgtttatttgggtgctctttgaactggatatatcagtacttgtatagttgcctcagtaaaaatcatacatgcttttgttagtcttcttgttaggtaatttttggatattgttgctattgtgaatggggtattttctatgacctgttcttaatagttattgtctgttttgcaaatcttttgattttgctttattgatcttctgttcgctatttttcacacgtctcttattcatttgactatttcaagtgtgcatttttttgaattttctagatagactgttgcattaccctaccaaatatcactctttctttccaatacacatacctcttatttattttggtatccatatctgtggctttgtattccaatacaactttgaaaaatagcaatgatagcatacatttatgacctgtgcctgacatgaatgcgtccaacattttacaattaagtatatttgctatcaatttgatgaaacaaaatttccttctactcttaattttctagttatttttatcatggatgattactaattttttcaaaatatttttctgtatccattaatatgatcatatgttttgcctctataatcttgttaatatagggaatcacactgaaggtatattttaatgtcaaattgtattttcattctttggatatatcccgtttttccatttagtacactgccctaatgaattggctattaatttatttaggatatttgttgctatgtgagtaactttggtttaagtgttcttttcatggtgaggtcctcttctggtatttgaaacaaagaacactagtctcagaaaatgagttccacagttgcccatctttttgtatggtttttaagagtttgcttaggatggcaatgagttctaattatttggtaaaactggcctctgaaactttcttttcctggatcatttgtgggtggcttgaactgagaatacagttttagtttgtaatgtttgattaaagttttctgtttctttatggaccaatttgatctttttttttttttttcgagacagagtctcgctcagtcgcccaggctggagtgcaatggcacaatctcagctcactgcaacctcctcctcccaggttcaagcaattctcctgcctcagcctcctgagtagctaggatttcaggtgtgcgctaccacacccggctaatttttgtatttttagtagagacggggtttcaccatattgtccagacgggtctcgaactcctgacctcgtgatccacctgtctcggccttccaaagtgctgggattgcaggcgtgagccactgcgccgggccatttttttttttttataaaatatagttcatttcacttaggatttcaaatttaatggcatgatattatgatgaaataactttattaaagtgtcagacatgtaaaatagtatagtataatatacccaatatacttgatattcagcatcaaaaatcttcaatccattactaatctgtttccaactatacttctacctaccccacgtctcaaatgctggaataatgtaaaccaactcagtaaccttggatagaatactggatccaataagccagttcatggtacagtgcagctgacctggctctgagacagcctatggctcagagaaaagggtctggcttcaatagaccagcctccctagacccctacctcctactctctgttccagggtcctgaggtactgcacgcctttgttctcttctagacacatgctcctataatactgctagctaatactgctttccagacacccttgggtctctctccaaatatcttctctgtgaggccttctatgaataacctttctttttcttcatagaatttgtgtctttattatttatttttgtaatttcactttcattttagattcagggggtacgtgtgcaactttgttacatgggtatattgtgagatgctgagatttgtgatattattgatcccgtcactcaagtagtgagcatagtacccaatagttggatcctgacctttcatcatatacaaaaattaattcgacatggattaaagattgaaatgtaagacctcaaactacaagaatcctagaagaaaacctaggaaacaccattctggatatcaccctcgggaaataatttatgactatgttctcaaaagctattgcaactaaaacaaaaattgacaagttaacctaattaaactcaaaagcttctgctcagcaaaagaaactatccacagagtaagcagacaacctgcagaatggaagaaaatattccccaactacgcatctgacaaaggtctaatattcagaatctataaggtgcttaaacaattgaacaaacaaaaacaaataacctcattaaaaagtgaataccctttctaaaattgcaatcctccctcttaactcatcccaaacacttattcagttctctagattcaatttgtttccatagtatttatcaccatgtcaaccaaaattaagactggttaggcaaaaataagaggataaatgtttattggaagccaaatgtgaggactgacctgggaggagaaaccaacaaagttgggagtgttctggagagtcttacaagttggaagggttttatgagagtttagaacaagagagaactttttatatggcagttgtcgttttttattagaggatacaatacggaggttagaatcattgtaccaaattgcaacatacagactaaaatgtccatgtgcaaaacaaccagtaaaatttcatgatttaaaaataaatcagcaaacttttcaatgttggtacattacatattaatccatatgtaaacaatttgtggaatgcaggataagacactttactgagggacaggatggcaacagaaatcacaagacctcccccaggtgagttcatttggaagcctaccaaaggtgatttggaagttaaccattaaatctactgcacctttaagtttgtttcatgatttattgtgtgcctaccctttacctcactagaatgtaagttccacctagggaggaaatgtgttcaatattgtatcctcagagcccaggacagtgcctggcacacaatacatgctcagtattcatttatggaatgaataaagaactgccagttctatggtcctagtatttggagcttctctggtactaaagtctcatggaattttcaatctttccaaacacccaacagccaaagtttgaatgctcccactatcttctaattgttggctcctggaccaggtaagcatctgagttttaaagggactccaaaggcctgctttcccagcttctggtttgtgctcctcacatcctgggtaagtgagcatggcagggctctagccacccagggctatctgaacactctctcttgtcaggaggcagctgtgacctttccctgatgccctgtttctttttccatcttgtttggatatgcaagttaacacagtagtccttgcaaggtggaatctaacagcctaattgtacctgttgggatttggggtttccttctcctgaggcccatctctgagcccccatcaccttggctgcagtgcccacacttgcccacagtctcccgtatctgacttcagtcttcccaactggggcttggaattgcagctctccaatacaactactcaagactcagtgctgaggcttatgaacagttaaacttttatttaaaattctctacttagaaatccccttccaaagtattatggttcagatagaactggcagaagatgaggtagccatttggtgagtttcctaggggttggtaaataataaaagaatgctgtgtgaatgagtgacaaatcactataatgatgacttacttttcaaatgatcccctatgtaatgcccacacattaattaaactaatcacctcgttaaggcgcctatgagtttttgctttctaaacttgatccagagaggtgatgccgaactgttttgtcagctacccaaagagccatctaggatctcggtgtacccccaaaaagtttaagaagactaatgggtgaaacccactgtgaggtctgtggtcattagtatactcctccaggtcccagaatatcctcaggtcaaattaggatttggaaaggagccaggaagggtaaggctttcttgttaccaaagggcataggctgtgatgagtttggaaaagtgtgagaaggatcacctgctggatccatctatagtgccttaggctggccacgggaggaatgtagaagtaaaatgggactggaggtgagctggagccctgcaagatgtcatgaaccgagtgcttccagaaagaactccagagcagactgctttgtcgcactccaggatgacaactgtgacacttagtgccctttgttggagagaaacgacggatggggagaatgctaactctaggatgcctaagtgttgcagggctagagcagctagggggtctcacagcaccccaccaacagcctcttctggaggcatttccagggtctagcatatcccacagcagcctcctgtgtggttacacaccacagaggatggaggcaatcctgaccagggtagggcagagcagatgggggccttcctgtgcccatacatgggaaggtcctgactgtctctagatgtcctgagcctgcccactgagggactgatgtgaggcctgtcagccatggtcctgctctcctaagagacctctctgttccaccagctatgactgaaaccctgcacttaacttcagcttccttggcaaggggctgacctcctgcatgcttcttgaaagctgtattagtccattttcatgctgctgataaggacttacccaagacctggcaatttaaaaaagaaaggggtttaattggacttacagttccacatggctagggaggcctcacaatgatggcggaaggcaaaaaggagcaagtcacatcttacgtggatgacggcaggcaaagagagcttgtgcagggcaactctcattttttaaaaaccatgagatctcgtgagactcattcactatcacgagaacagcatagggtaactgcccccatgattcaattatctcaaaccgtgtccctctcacgacacatgggaattatgggaattatgggagtacaattcagaaggagatttgtgtggggacacagagccaaaccatatcaccagctcttccctgtgccaattaccctgtcagcttttcctgagcaaataaggagtcctgggtctccttttatccttgatcccagggctggagctgaacatagggatagcgggggctagtggcaggatgcttgttatgtcccaagggaaatccacaaaatagcatcagaggacaaagccaaggttgcccatcactcagactgagggtcagtgcaaacaagccctgcagacactgacacctacgtggatgcagtgagagtccacatgtctcatgagcactgcgctccgtcctacttgccccaccatgtatctggttgccagcctgctcagtggagttggctcgaaggaaattgttgagtcatctaatctgctgagaataaaagagaccaggccaggcaggtacacagcaaggcagggcacatgtctggacataatagcagcctctggaagactggacttctgatatccatgtcaaatggttgctgtagcttagcctgggcaactgcacttgggccatgagctgccagggtaccctaaaggtcaatggaagtcttcctggaggctggacttcctggcatatatttgaggttctaagcctgcttcaggctccaccatcttctcacttgatttatctctgggatccctttgttttatttgtgtgtaatgcattttatcttgctgtgttacgtacttctttgtagcctgctccaaatattttctgaatgaagcaggagtgaaaaaaagggggaggaaaatagtgagcgaagtcccttctcaatcccacttaactctttaatgtcttcacctcatctgcattcccctctggatccccagtgttctgttaatggagcacaagctcattgcaggggtcgcggttctgaactgcagcccatctggagctctcaatgcagaaacttgtccatcttcacaccctttatcctaggacccacctctcctccacagcatttgtctccatgtcatatggatagaacaggagagaggccattgggtaggattctgtttcaagctttcactggcaccaccacttggctcctttaagatcagtcctaggggcatattgatagggcaatagttagcagtggaagatggctggcactcccttgtttgtgggttgcagctcaacccagtacagagacagggctttgaacccataagaaagtaagtttgaatattagctctgtcgcttataagcccatacatcaagtatcctttatgtacttcagttttttcatctgtaaaatgggagtaataatagtacaacttcagagtgtttatgtgagcatcatataacatgccacttgtatgtaaaatgtttggccctaataatgtggtcattaataagtggctattattattgtgtgcccatgatgtaccttcccccatattttaatattcctgaacctgtatatgtcttatgatccacatgtgcattaattaacgcatttattttcttttccccttgaaaatctgttaccttggattgtttaatcccacatctttgagctgtatagacatgatataacttgttctagtcctgcttggggcaataaccagggctattgaaccaggacctagatcaacacataggtctgtgagagttgctttgaagaattcctccaggctcaccctccctgcatccaatctcacaccccagagctctgcaagggagagtcctccaggtgaacacactgaatgccaaagaaaaggtcccacactgtgcctgaccctggctgcccaggttcacatctctgaggagtactagagccacattccaaattctccacaccactgcttgcacttcattgggatggctcaatggttattttaaaaagtacattgttccttgcacaaatgtttttgtattttgaaaaagcctagagttacctactttccaagtataaatctctttttgtgcctaacatgttgtcaattttcttttctccctatcttaaatttaaaggagcagataaaggcaatcttatgtgcccagaaagaagagaaccaaatatttgtgaccagccctgatatgcacaactgaggtcattttagaggaggaagctgaggccccttttctccatctgcttgtcattgctctagtctaggcctgctcttatcctgtgggaatcctcaaccctggacattccagcctcttaacagttactgtatgacaatagcaacacaaagaagtagggagagaatggaactgtatgtgaacaaacccattgtatactattttaattaagttggtattaatttaaatagattggtacaagttaaactatcaattgtagtccccaggacaactgctaagaaaataataccttaaatggcaatgggattaaaatggtagactagaaaaacatatatttttcacaaaggaaggtagcattgaaaatataaagaaggaaaaatacatatgtaatataaagagtaaatcactgactacaacacagaaatattaccttaccagtaatcttaaatgtaaatggattaatcacctcgattaaagtcagagattggggaaatatattttggaatcctgttctaactatatactgattatttataagagatttatatagatgtatacatctaaatacataaataggatgaaagtaagtatatgggaaaagatatatcatacaagcagtaaccaaaagagagctggaatggctatgctaataccagacaaaatagactttaaaataaaagttgttactagagaaaaagaaagatattttataatgatgataaaagttttagtctatcaaaaatatgaaacattataaacatatatgtacctaataacacagaccccaaaatatagaaagaaagaattaaagagagaaataaataattcaacaataattattggagactttaaaccctaatttcaataaaggtataacaagatagaaggtcgccatgactatagaatatttcaacaacaatataaaccagccagacctaacccccaattatagaacacagcacccaaaacagcggaatatttttctcaagtatacatggatcacctttcaggataaacaatatgtaagcccacaaaacaagtctcaataaatataaggggattgagattgtacaaagtactttatctgtctgcaatggaataaaatatgaaattaacatcatgctacctgacttcaaactatactacaaggctacggtaaccaaaacagcatggtactggtaccaaaacagagatatagatcaatggaacagaacagagccctcagaaataacgccgcatatctacaactatctcatcttggacaaacctgagaaaaacaagcaatggggaaaggattccctatttaataaatggtgctgggaaaactggctagccatatgtagaaggctgaaactggatcccttccttacaccttatacaaaaattaattcaagatggattaaagacttaaacgttagacctaaaaccataaaaaccctagaagaaaacctaggcattaccattcaggacataggcatggacaaggacttcatgtctaaaacaccaaaagcaatggcaacaaaagacgaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaacttaaacaaatttacaagaaaaaaacaaacaaccccatcaaaaagtgggtgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaacctagttcaacccttgtggaagtcagtgtggcgattcctcagggatctggaactagaaataccatctgacccagccatcccattactgggtatatacccaaaagactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtcaggggaggggggagggatagctttaggagatatatctaatgctaaatgactagttaatgggtgaagcacaccagcatggcacatgtatacatatgtaactaacctgcacaatgtgcacatgtaccctaaaacttaaagtacaataaaaaaaaagttaacatatttaaatttccaaaaaaaaaaagaaattaataacgttggtaaatttcagatattcacaaatttgtgaaaattaaactacatactcctaaacaaccaacgggcaaaagaaaaaatcacaaaggaaattagaaaatattttgagataaatgataatgaagatatatatacacacatggtcatgtacaaatgaacaccagctcatcgcatagttcaagtgcactagcttgcattgttgattgcacagttttagagagacatgttgatgaccctattttgccacttccagagaccagatgtactgtgcaattaaccagaaaacactgatttataaagcatgaaaataagaatctcttctgagcttataactaaacatatctaaactataataaacattaaattccaaggacttgatatggtttggatctgcatccccacccaaatctcatttcgaattgtaatccctacatgtcaggggaaggaccatgtgggatgtcatcagatcatgggggagggtccccccatgctgttctcaagatagtgagtgagttctcatgagagcagatggttttaaagtgtagcacttcctcatttgcgcaaaccctccatcctgcagccttatgaagaaggtgcctgcttccccttagtcttccaccatgattgaaagtttcctgaggccttctagccatgcttcctgttaggcctgcaaaactgtgagtcaattaaacttttttcctttataattactcagtttcaggtaatattctttatagtggtgtgagaatggactaatacaggactacagctgtgcctgaacaggctacatcaaaaataataataaaaaaactactccaaaagatgaacaatggctacctctgccaaatggaagagtttagatgggctgccttctcaagttgggaacacaatcctgtacatacgtgcttaccagtgccacaccatagatttacaagtcagcatgggtaacccaatcagagactataaaatacccctcaataaatactttgttgcacagcttcaataagtgtgcttatctgacagcctaatatctctttcagggactaactttacagctgaagtcacaatcttctaggggtggccaccaatcaatgattaggcaatgcagttttagtcaagaacatacacttctcagaaaggccaccagccaatgactgagcaagtcgagggtaaaatggcttagaaagtcccataaaagggacccctcctccaagcaatctttgcttcagagctccaaattggactagcaaagactttgtgagatctgcccaaaagacaagagggagaaattgggtatgtgcaattgttaagtacttacatgacatgcgaaataatatattatttgaaggtagattgtgattaagtagagattacattgtaaactttagggcaaccacaaaaaattcactaaaagagatatacataattaggcaacaatgaagataaaatggaataatagaaaaatgagtgcctattcacaatagcaaagacatggaatcaacccaaatgcccatcaatgatagactatataaataaaatgtggtacatgtacaccatggaatactattcagccataaaaaggaatgagataatgtcctttgcagtgacatgaatagagctgcaagccattatcctcagcaaactaatgcaggaacaggaaaccaaacatcacatgttgtcactcatacgtgggagctaaacagtgaaaacacagggaggggaacaacatacaatggggcctgtcggtggtgcaagggaaagagagcaacaggaaaaatagctaatgcatgctgagtttaatacccagaaagctgggtggcagcctgagggccatcaactcatgcatttaatcagaacaaagaggtacgcatcaagcctggaacaaagaaatatattgtctcacaagacaataagcccagcacaggctgtgagggctctttatctcccaagaagaaaatgttccaggtacaaggcccatcttatgcagctgagcaggttggtcaacagacaggacatgactgcctttaccaacaatattaaaaggagaatgtatcattattgagatttgtctcagaaattcaatattcacaaatcaatctctgtaattaactgtatcaacagactaaaggaaaatgcatttgatcatattcaaatgattaaaaaatttttatgataaaaagtctagacaagtcgaattaaaaaagaaataattcaacttgatataggacatgaaaaaaaaaagaaaacctctacagttaacatcatacttaatgatggactggataaaaagctgggatgtcaattctgaccaatcctaccaacatctctgtgaaagtccagaccaatgtaataaagcaagaacaagatattaaagacatactgacaggaaaagaaaaaaatgaaaccatctctatctgcagatgacattgattgtatttgtcccttttcacactgttataaaaaaatacccaagactgagtaatttagacaggaaagaggtttaattgattaatagttccacgtggctgaggaggactcagaaaacttacaatcatggcagaaggggaagcaaacatgtccgtcttcacaaggtggcaggaaagaaaagtgcagtgcgaagggggaagagccccttataaaacaatcagatcttgtgaaaactcagtcagtatcatgagaacagcatgcacctgcaggcccaataccacctggaaaccaccaaggcttggggcttgcactttctgaagcaatggcctgagcagtacattggccccttttagccatggctgggatgcagggcaccaagttttgagattgcacaaagcagcaaggccctgggcctggcacacaaaaccatttttttttccttaggcctcaagccagccaggagtcctgaattcctagccttcccacccctaggaaccccctacccctggtaggggcgaaagcatctgatgtcaaaaagactcaagggcatcatggaccttccatatgggtacaggactgcaggacgtccatcagcctcgaaaagacctctccactgcctttcagttgctagcttctcagactcataggcccaggcgaattacaatggggctgccgctggcctgggaagagcaaaaactgtggggccttgcacgtagcaggaaaagactggaaggagactcaagaccatgacaactcctttctgtgaggagccctgagagggtgaatcggtaatgatggagggtgccaagtgagaagaatgtaatgaagggatggttgtgaaatttgaggagagaggcggtgaggtcagggaagagatgtggggtcctcaggagggtgttgaatagggagagggcacagggtcaaggggtgtggtgcttggggtctgcagaggatgtggggtcaggaaagggtcttaggatttcaggtgtggggacacacagtgaggtcccaggagtggggcccattgaagtggaggctctgttctatctgcagtcttggtccacactccttaagattaaccagagaaacacgtagaggacaacaagatagtgaatatggacagagcagtgaagatgccagtggccacggaaaatactatttcttccatgctgtctccagggagtgcttgctgcagtgtttgatggaaggtacagcagtaggagtggtgtcagcttcgacctgcccgagcagagggacagtacttgaaggaaatgctagggccagaagccatgtaaaagcttccaaatgcacgtgtgtcagggccagcagtggcaggaggagccagcaacccagaccctatgactccttctgcggggatcagtcagatggccttggcattggtcagacaggaagtgaggtgggttaggactgagaactaccaggagtcagcagggcaccaccagcttggatcctgagtctggaagaagacctatacctgaagcagtgcccctcctccctcggatttgccccaggtcatccctaggaggccatcccattcttctcctgccatctcaggaaagtacatcacagtggagggcataagccagaccagcacccccaaccaaccatcatcccatgcgtgactttacacacagatactttcctacacacaaagaccaattcaaagctgcttgtcaccatctcttaagtgaatctttaagaagcctaatgtggcagggcttcaggtcagggccacttgatcaaacccagcaccttctgaatgaccaccagggcacaccgagaatctgcctggaggaagcccaagccctgccctgactgctttttctctacttcacctttctctcctcttccaggaaataaatttgcttatgctgagggtcagttgtcaccagtctgacttatttcttccactctgtcctacaacagtgcttctggactccaggcaatgctcctccaaccgcatcacctgggggctagttaggaaccagcatctcaggccccactcagccctaagcagtgagaacctacatatcaacaagattcacaggagactcctgtgcatgtccccatgtgctaatccagacgtggtgtttcttctttgtgcctctgcctcagggagtctgtgactcactgaattcagggtcctctgttcattagtcaggtggaatcaggcaggatgtcctgactggatccttttcagaatcttccgccaacaaaatcataccacatagcaagagctgctttccactttctgaagtggatgcacttttttgcaatttaacattcccagcaacaatgtatgagggctctaatttctctaccaccttgtcaacacattattgtcatttttattgcagccattgtagttagtatgaaatagtatctcatttaggttttgactcgcatttccctagtgactaacgaagttgagcatcctttcatgttcttttggccatttgtagatattctttagggaaatttctgttcatattctttgctcatttttaatggtttgtcattatatggtggtattgtaaatgttccttatgtattctggatacaactttcttatctgatacatagcttgcaactgttttctctcaatctgtgggttgtctctctgtctagaggtgccttttagagcacaaaaaggttttttgttttttttttgtttttagtttgaggaaatctaatttatcaatttgtgtttttgtgggggaaaactatgctataaattggagggaaaaatgcaacctagccacagtatgagctcaaggaagacattttttgaaagttgaaattgtcacattatttttaggtgtcaacgatccagtaaagagcaaggattagctaataaaagagaaaaaatgagacaatttcaagagaaaaatgcttgagaaagagtccattctaggctcttagatagtgctggaatgctttgtcttttgtcagaaaagaaatgacagagaatgcaggcatattggtggcatcagaggcgagataaagagtgaactgccatcaaatagctttcgtttgccttatcagaaaggtggaaaattggccgggtgtggtggctcatgcctgtaatctcaacatttggaaatccaaggtgggcagatcacctgaggtcaggagttcgagaccagcctggttaacatggtgaaaccccatccctactaaaatacaaaaggtagccgggtgtgatgacaggtgcctgtaatcccacctactcgggaggctgaggcaggagaatcacttgaacctgggaggcagaggttccaatgagccaagatcatgccattgcactccagcctgggcaacaagggtgacactttgtcgaaataaaattaaaaaaaagaaaagaaaagaaagaaagagaaagaaaagaaataaagagaaaagaaagaaagaaaaaggaaaatcatcagatactgttgaaggctggagtgttttggagatttgagaagattcgaaatagattttttgcagagtgagaaagtgaattcactagaggaattgagcaagttgtctcaaatacttcaaaggacatcatcaaaaaattgaaaaggcaactcacagaatgggagaaaacatatgttaatcatagggataaggatctaatatccagaatattaagagaacagtcacattttaacaattaaaacacataaccccatttaaaatgagcaaaggatttgaatagacagttctccaaagaagatacataaatgcccaataagcacatgaaaaggtgctcaacatcgttagtcatcagggaaacacaaatcaaaatcacaatgagataccactttacatacactagaatggcaaaaataaaaatgacagacaataatagtatctctaaggatatacagaaattagaatcctcatacactactgctagaaatgtaaaatgatgcacctgctatgaaaaacattttggaagatcctcagaaagttaagaatggagtgttaccttatgacccagccattccattcctagtcctacacccaaaataattgaaagcaaataatcaaacacttgtacatgaatgcacatagacgcattattcataataccaaaaagtggaaataacctaaatgtccatcaagagatgaatgtataagcaaaatgtatatacatacaatgaaatgtcattcatccttaaaaaaatgaagtgctgatacacgctatcacatgaatgaagtttaaaaataatatggtaagtgaaagaagacaaacacacacaaaaagctacatgttgtatgattacattattatgaagttcccagaataggaaaatctatggacaaaaagtagattaattcctgccaagagctagaagaagagggaacggaaagtgattgttaatgaggaggtgttttctcttggggataatgaaaatgttctggaatttgatatggcacaacttattaatagttaaaaatagtgaaatgatggaatcatacttttgaagtggtaaatttatggtacatgtatttttttaaaaaagaaagcaaactgacaacacatagaattgtggtgaagaataggaaagagcatcagtagagagcctctctggggtgcagcctactgagctcataaaagctgaagagggggcaggaactctgatataacactctcacatgatagacctcactctgcacacaggtagagacagatcaccattgggagactttgaaggtgatagcaaaaacaaagcctaaacccggctaaactactgaagaaattgaccacacacttccctcacacacaaacttacaacctagctgaataagatacattccaatttacatgcattaatattatttacctcagcctctactgttcttctacacatgaggactggcattcaataaaaattataaaatacaaaaaaattaataactagtaactcattttcatgaagaaaagcaataaacagacctggactcagaaatgacctaactgctgactacattacaaagatacttgaaaagaattgtgattaatatgtgtatcagtccgtttgcacactgccaacaaagacatactcgagagtgggaagattacaaagaggtttaatggacttacagttccacatgactggggaagcctcacaatcatggtggaaggcaaggaggagcaagtcacatcttacatggatggcagcaagcaaaaagagagagagcttgtgcagggaaactccccttcatagaaccatcagatctcatgagacttattcactatcacgagaacagcaggggaaacacctgcccttatgatttgattacctcccaccgggtccctcccacaacacgtgggaattcaagatgagatttgggtggggacacagccaaaccatatcgacatgttaaagaatatagtggaaaaactgaacaatatgcatgaagagaagtatcaagaaaatcatgaatcactgcacacacttgttaaaataattaattgggaggccataagactgaagcagctctagcaccctgagttcctatgtaaacaaactgaaactttactcaatacaaatggaaaaatgaaacaaactttaccaaagttggccagctaacctctaacaggggctttgccaatcagaaaccaccaaacaaccactaactaggggctttaagactactgctccactttttttttttttgagacagggtctcactctggtgcccaagctgttgtgcagtgttgtgataacggctcactgcaacctatgcctctcaggttcatgtgattctcatgccttagccacctgaatagccaggattacaggtgtgtgtcaccacacccaggtgatttttgtatttttagtagagatgaggttttgccaggttggccaggctggtctcgaactcctgacctcaagtgatctgtccacttcaaccttgtaatgtgctaggattacaggcatgagccactgctcctggccctacagctccacctaaaccaaaaaaaaaatattttctttgccttgcttctgcatgcacatcataaaagttctgccctcatgcccttttggtgaagccctggaccacttgtggttttatgctgcccaattcatgaattgctgtttgctgaaataaactctttacaattttaatttttctaagtttatcttgtaacacaactattttcagtttactgtacatattgaaacaaataactgatctctgagcgatgagagatagaaaataaagtgagccctaaaatttccttagcttactgcctggagggcagagtacacagcaggaaagccttgatgttttttgagttgaggaggtagaatttagaggacagggagactaaaatttgcagaacaaaataatgaagaggagaaagcggtacagagagaaatctccagagcttacatgggtttgaggatagttcttgtttcctctattcagagtgaaaaactttataaagcatgggacatcagctaaaaaccttaagagcgttttgtccaggttatgaggcattataagctatagactaaaaactgctctgatctcacctaaaaagagcaagacttgaaaaaaatgccactattttcaagaaacttacccatgctgaagaataaatcccaataatattttatagaaatacaaaactatctagcactcaacaaagtaaaattcaaaatgtcttccatccaatcacaatgaccaattttgtaaaaaagcagaaattaggatcaataatgaggataaaacacacacatgacactgataatagagattgtaggcaaagacatttaaaaatttatgaatgtatatgagaaccacaaagcagaggggaaaatgagggataaaaaaatacttgaggaaataatgaaaagttttcaggtttgataaaaactataaaccccaaaatctaataaactaaaaaaaaaatcgcaaaacaataaacatgtataaaggtataccaaggcatttgataatcatattgtttaaaatcactgagattttaagaagaaatcacaagaaacttttaaaagtaaacagagatacaaattatgtacattacctacaaaggaacaaagataacgatgacagcagatttcttttgaaagataatgaaagccagaggagagtactatatttaaatattgaaggaaacaaatactaaagacgtaaacttctatattgatgaaaatatattccaagaataaagatgaaacacttttgtttcgggaatgcaaaattagaatgaatttatcaccaacatatgtgcactagaagaaatgttaaagtaagtcctccaggcagatggaaagtgatgccagagaaaaatccggatctacacaaaggaatcaagagccctagaaggtgcaactgcatgcataagtataaaacatattttccttattatgtaatgtcttcatagcaaagtaactgtttaaaataacagtacttaaaggtattaagttaaaaatagcaatgtatgatgtggcttacaacatatgtaaatgcaaaatgtatgcttagaatagaccataggatgagaagggggaaatggaagtataccgttggtttttatgtatctgactattctaagtgccaatgggtagagctgaatagagatgactgttttcctcattgcacatgaggtatactaataaggtgagcctgcacataacaagacatttttaaaaaacactcatcgtttattatgtgaacagagagagtgctgtgaactccagacaattactctgtaatattccttaaatgagaaactcttatagaaagaactttaccttgttttcttaaaggaaattaagagacatatctctaataaattttggttgagatgaagccatctgaacatcagtcaaggggattgtgcaccatgtgcggaagcagaggcaacaggtaaaagtaaaatgagtcaagatccttgctcttgttgagcatgcttgtacatggtctaagaacactctcaaaagaaggaaacacagtgaacatgcccatagtgctgtttggtgatgataggcagtagcaggggcctctttcccggaggagaggctgaagcagggctaggaatgaggttagagacagagattggggccaacactaaggaagatccttgcaaaattctcagagggatagtggattggagggagggagggtaaacagtcccattttgagaatagagaatagataaatatgtagaagaacagtgtgtgcctacgtgtgtttaggtcaggggtaggacaatgaagaactgggtaaacaagaggtgacatggtgaggtatgctgatgataaaaagattgggggctatcagttgttggcagggctggagagccaggaagcaaaattgggattcagtgcattgggcagaatggcatccacatagatatgtgcctgtgcaggggcatgatgaagcccacctttgaggaaggtcttctagcacagggctttcccagcagtgcaggggcatccccagtgttctgtagcaggtaaggcatcagggcccactgcctaaaggagggagaaaggatgctgggcgaacaggactctgggactagagtgctcacttcagccagactgctctgccttctaatgttcataaattggagttctatggaaggcttcagttaaaataagggattctatgtctaaaatttggcaaccatggtctactagtgagatatgggatgcattgtggtgtcctggcatcctctacttgtgcctaatattgctttcagccctttgcttcactgactttagttactgcaaagttgccagctgcctagaacacactagattagaagaggtttaacaaggaagtgtgtaccatctccatgggttttccatctaccctccaaatatctgcactttaaaccaatcctctattccagacattatctgctgacatatagacccacttttatagtcacaggacacaggttctctgttgtgacaaggacgcagaaaccatgggaggcattctgagctgggaacatcatctggatcatttttcatagccctttatctatagttactgaattagttggtcctgggcattcccactccagcttacccctccttgcagatgcacattcccttaccttgctcattggtattcctagcctgtatcaatggtcagccatcagtcaccagctccacttgcatagcacccacctctatgaaaggggtccagtgtacacaggaaaaaaattgtcagcctccactgggggtcaagacagctccctgccctggtgagagtgcacaggattactacagtgatcaagagaatgactcaggcagccagctatacccttcctgacaggagatggggaaattttaatgtaggctaattgtatatgtatatgtatgtgtatgtgtatatgtatatgtatatgtatatgtatatgtatatgtatatgtatatgtatatgtatatgtacatacatatatcactccatgattcctgacattcttatagatcttgttatttcctaagtgagtaaaacaatacgaatatctttcattaaaatatttgtcctgttgtctttggttcccgaagcagcttcagaacagcttcggaatagtaaaggtggaagacagtcttctgttgtaatgttggagtgctttaggcctcagaaggagacctcggaaaacacaatctcgctttctaactttcttttgcccccctttcaccttcttctttttctccctaagacaagccatagaaactaaaaacagtcatctctcctcacctgtcttagagctggtcataaagaaattctctgacctaccttgtctgattgtaggtcttaaactcccatttcagaagaggtcctgacccataccctggaggacacaatgctgctcagggagaacaggaagaatctgaacagacaggccttgctggtttcccaactcagtctcttagtattaggttatatctttctgtccaatcatatttctacacatctgtccatgcttcaatcatgcctatccaatgaagtcttagtaaaagggtcaggaggacaggatattgagagcttctgaacagctgaattcatggaggcttccagaaaggtgcataagaactcatccacgtgccaggagagtgctgcaccccaactgcatgggaacagaagcccttgcagggcagaccctccagaactcgccctatgtacctctttatatggctgtttcattgtgtcctttaaaatatcctttgttataaaccagtaaacataaatatctccctgagttttgtgagctgatccagcaaatcaagcctaaagaaggggtcatgacaacctgaagttgaagccaatcagttagaagttccagaggcctggacttttgactagcatctgaagagagggcactgttgtgggactgagtcctcaacctgtggatctgatgctatctccagatagatagcgtcagaatggaattgaattaaaaggcacctagctggtgtctgctgtagaattgatttcttgctttttggtgaggagaaatccccatacattcagtcacagaagtcttctgtgttgattgttgtggtgtgaaagcagatgaaaacagatgaaagcagatgaaatgccctggtgcattcagctaccgggcctgctcactcacatcacgtggccatgttcagctggagattatggttcccagatttcccaagcctattcctgctcattgtcctgtcctccctactgcctttccccttatatccctcaggtccctgatcccactgggctgaactctggattgagagctctgagtgccagcctgcctggggctctgtggacttggttgtgtgcgtggtctctctcatggactctggcagttgccctttcttggatcctcctaatgcccctcatgagctgatggtgtcctgtcttctctccttccctgccatctggtcagtctgactgcattagtccattctcatgctactataaagaactggcagagactgggtaatttataaaggaaagaggtttaattgacacaaagtttcacaaggctagagaggcctcaggaaacttacaatcatgcaggaggggaaacaaatatgtccttcttcacatggtggcagcaaggagaagtgctgagcaaaaggggaaaaagccccatataaaaccatcagacaactcactcactatcacaagaacagcatgagggtaaccatccccatggttaaattacctctcaccatgttcctcccatgacacatagggattatgggaactaccattcaagatgagattttggtgggacacagccaaaccacaacattctgcccctggcccctcccatatctcatgtcctcacatttcaaaacaaaatcatgccttcctgacagtctcccaaagttttaactcatttcagaattaactgaaaagtacaacttccaaatctcatttgagacaaggcaagtcccttctgccgatgagcccgtaaaatcaaaagcaagttagttacttcttagatacaatgggggtaaagacatccattccacctgggagaaattggccaaaacaaaggggctacaggccccatgcaagtccaaaatccaataggtcagtcattaaaccttaaatttccaaaatgatctcctctgatttcatgtctcacatctaggtcacgctgatgcaagaggtggtctcccatggccttgggcagctctgcccctgtggcattgcagggtacaaccccccacccaacttccctcaaggaagatcccattctgggatctggaggactgtagttctcttctcacagttccactagggaataccccagtgaggacactgtgtggaggctccaaccccacatatcctttcatcactgctttagcagaggttctccatgagggccccacccctgcaagaatcttcttcctgaacatccaagagtttccatacatcctctgaagtaggcagaggttgccaaacctcaattcttgacttccctggaccggcaggctcaacaccacagggaagctgccaagacttggtgattgcaccctctgaagccatgacccgagctgtaccttggctccttgtagacacggctggaggggctggaacacagggcacccagtccctgggctgtacacagtatggtggccctggcccaggaaactatttttccctcctcagcctctggacctatgatgggaagggctgccgtgaaggtctctggcatgctctggagacattttccccattgtcttggtgattacatttgtctccatgttacttatgcaaatatctgcagttggcttgaatttctccccagaaaacgggattttcttttccactgcattgtcaggctacaaatgttccaatttatatgctctttcaccttttgaatgctttactgcttagaaatttcttctgctagatacgctaaatcatcactctcaagttcaaagttccacagatctctggggcaggggcaaaatgccaccagtctgtttgctagcatagcaagagtcgtctttattccagttccctacaagtttgtcatctctatctgagaccacttcagcctggacttcattgtccatatcactataagcattttggttaaagccattcaacaagtctctggaaagttctaaactcctacatcttcctgtctcctgagctctccaagtctctaggaagcttcaaactttcccacattttcctgacttctgagccctccaaactgttccaacctctgcctgttactcagttccagattcgcttccacagttttggtatctttacaacagctcgccactacccgttaccaatttactgtattagtccattcttatgctattataaagaactgcccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagaactgcccaagactggttaatttataaagaatagaggtttaattgactcagtttcacagggctggggaggcctcaggaaacttccaatcatggtggaaggggaagcaaatatgtccttcttcacatagcagcagcaagaagtgcccagccaaagggggagaagctccttatacaaccatcagatctcatgagaactcactcactatcacaagaacggcagcatctgggtaaccactcctatgattcaatcacctcccacggatacctcccatgacacgtggggattatgggaactacaattcaagatggcatttgggtggggacacagccaaaccatatcactgaccaaacccttctcgaagtaaagataaatgggaatttcgtgtcagaagatgtttactgcacagtgatttccatggtctttcttcatgtaccactgtgagagaggctatggttttgaccacctaggaaagtttgtttatatgctcagtactcagttttaaataaggctacatcaaaggcattcttcatttctgttacattacctttgaattctagcactcactttagattatttaatacagttttcacctctttgctgtcatttcccatctattcttgtgtgttgtctactttttttattagaccttaaacatatgaatcactgatattttatattcatattttataagtataaaatttgtgttatactcagtctgcttttgcaacttgctttgtcacctcaggctctttttccttgccttgcgtcatgctgtggaagtttttgtgaaaaactgaatgtgatgtatttggtaatagtaaaccaagatgaaaagcttttagtgtgatactttctgttaatttgactaggtcttggacagggcttaatgtttgctgcagctgtaggtgccaaagccttcaatgccctgcagtattcttttttgtctccctcctattgtctttggttttcttaataactaccaattaaattaagcctctgtcttctagctcttcatccattgtaatccactgtcgatgtggttgtatcatccattgtaatccaccatcaatgtggttgtaaggtgttagggaaagaattgaaaccatctttgtaaatgttatacaattaatcagggaagaagagaggaggagaaatgaaaacaaaccaagctttcagcacagtcagcattaatcactaggttagcttgctctctgacccactcctcatagtcatttgtctctgcctcaaaatcacacagaccttgttatcagattataggtccccataattgctctatagatagcaacttaaacattctgaaacgttaagttttccttttgagatattctttccaatccttcataccagtgaaacctactgattgtagctggtctgaaggaccccaggaggagctggctcacggaagaatgcagtttccacatcctgatgacttcatccctcttaccccaaacaatcaacgactccaactttcagcccttgccctccatgatcctcttaaaaactgtcacgcgtatccatgtgaaaagaccaccaaacaggctttgtgtgagcaataaagctttttaatcacctgggtgcaggcgggctgactccaaaaagagagtaagcgaagggagataggggtggggcagttttataggattttggtgggtagtggaaaattacagtcaaaggggggttttctcttgcaggcaggggcgggggtcacagggtgctcagtggggcagcttctgagccaggagaaggaatttcacaaggttaatcactcagttaaggtagggcaggaacaaatcacagtggtggaatgtcatcagttaaggcaggaaccagccattttcacttcttttgtgattcttcacttgctttaggccatctgaatgtatatgtgcaggcttgggctcagaggcctgacaaaaatctcatcccagaactccttggggagatggatttgggggtctcctcccatctccttactcagggccctgtgatgattaaactctttctcttctgcaaactttgctgtcttagcgtattcaactgttactgctcagtgagcacatgaacctgttggtcctataacaggatcattcttaatcttatgattgaattgcaggacttattgaatatgtgtctctgagttgtggccttcgtgactgtttcaccagcagtatagtttctttgccccatttcccccaaatccttttgctcactcctgtgttcctaagcaaagaaagactgtcaaatcaggcagctccagaaccaaaataggttcagagcaactccagggttgccacgtggtgagataatatttgtgaaccaataaaggatagtaatatacagaaaacagaaatgacgtacagaaagaactggattggcaacagctggggatttgccttgtttgaacctgctttgaacagttggctgcctgtggttgactaagactcagttgcttgttacaaggtatattacaatctgtctatacttcaagttaggttacacttcactatgtgtagaggaatctttaggccaaccttcaaatatgtagaggggaagctttagatcaaactcaatttgatatcctttaggtaagacaagaaagctagaagtttgcagtgggaggaatgccattccccaagctgggatgacgctatggcaaagccttttactgctggagaacacctttgttatggagaaggctctgagtgtttttcacaatagctatttttctcctactcctgcccagatgaatgagagaagcttgctcagaccttcacggtgagaattcgctgatgctcctggaggtaaagcactcaacaatttgcctcccaagactgtggctgccaagtaatttatcactctcatggtactccacattcagcatctaaaatttcattcaattaccatttaaaggttttttactaggttacagacccagaattgtctactcctgataagtatatcttagctttgcctctttgtacctgactctcctgattttgggtggtaatttgccctgcaacatcaattccttagtatgtgtgagaaaaataactgattttcagtttgccaagcatatttttgtagtaaaaatgaccatgtcagtgttcaacacctttacagtcagggctgaagttagaagccctgtattaactttttagttaccgatttatattatgtatacctgttagattaggcagatagccagaaatgagcaggcaagggagtccctgggaaaagaagtcctgggagacactgcccactgacaatcagaaaaaaataaaaataaaaataaaaataaaaaccaatggctatattggctacagctggccttgtggttaggctcttccagcccagaaggggtcttaccaggccctaactggaggcaacaatggtagggacttttcctactgaggagcatgcacactcctcccataaatcaccctggagtagccttttgcttattataatagtgaaaaacacaccctggggtggagactttaaatgctaatgagacatgccacatgtgtactagtatgcacaaccacagagcatgtgcggtcaaggggaccacataaaacatgattgcaagtgacattccgtcatgccccttcatgaataatcatgtaagattctcataaagagagtcccccagcactagctgctgctggctcattctctctttcaacagcccactctgatttgtcttccagagtgtactgtctctttaaataaacactgctattgctctttttccagccaaaccagccaaggtttgtcctagggcaatcaaggctatccagtcaagggattaatgtgctcacttgggtaattgatagtgattatcaaagtgaaatattagttatgatggaacgtaaaggtctgcatattcttctccctggatcaaagatagcccagttaatactcttaccatactgggtccccaaagcccagggaaaagaaaggggaaagggaagttttggaagcacgggagccacaggagtatattggaaccaattaatcgcttatcagagacccatgattaccttaaaaattggaaataaaaatgttactagcttattggacacagaggtggatatttcaatcattagcgatcaaaactggccagaaacttggccttcggtcactcagaaacgaaaaattgtcggcatcggggaagcgcacacagccaagcagagcacacgccccctaatatgttgcgatttggagggaagaaaaacagttatacaacctctaatcatgtccatccctgttaatctttgggggcgggacctattagcccaatgtggggatcactctacagacccctttctaataatggccactgttgtaattcttcccctacccctcacgtgtctctctctagatccagtttgggtagaacagtggcctttaaagggagagaaattacaaagagcccatgaactagttgaggagcaattaaaagccagccatatagaaccatcaaatagcccttagaatttgcccatttttgtcattcccaaaaagtctggtaaatggagacttttgcatgacttatgtgctattaatgctaatttgtaacctatggggccccttcaacaggggctcccttcccccacggcgattcctcaagattggcctacagttgttattgacttaaaagagtgcttttgtactattccccttgcaaaacagggcagagaaaaatttgcgtttacaataccagctatcaataatgaaaggccagcttgcagatttcattggaaagtgcttcctccaggaatgctgaacagtcctaccatgtgtcagtaacatgtaaatcaagcttcgctccccagtagaaaataatttcctaattgcaagattattcattttgtggataatattttaccagcagccccaacagagccagtacttttaagtttatattcctctgtcgtaaagaacacgcagttaagaggttcaatcatagcacctgaaaaagtacaaatgtcctctcctaggaaataccttgggcacatactaacttcccggtcagcaaaacctcaaaaggttaaattaaatactagcaacttacacaccttaaataatgaccagaaattactaggcaatattaactggcttcgccccaccttaggcataactacttataagttccaaaacctgttttctatattaaaaggcaatgctgctctagactcttctaggcacttaactcctgcagcataaagggaaattgagggagtagagcaagctatttctcacaggcaactagattgcatagctccatgatattcagttcagttgtttgtttttcccactaaacattccccaagaggattaataggacagatgggcccagggctgcactttctagaatgggttttttgcccacataataggactaaaacactctctctatatatccagctaattagtaaagtcatccattcaggccgcagacaatgcaataggttgctaggttatgatcctgatgtcatcagaattcctttgagtaaaaagcaattcgaagcagtattgcctttatctttaggcctgcaaacagcactctctgattacacaggccatgtagagcatgcccttcctgctgataaatgacttcagttcttatctcatacttctgtggttttgcctgcaaaaatagctcactcccccatacctaacattttaacactgtttaccgatggctctggtaaacatggaaaagcggctatttggtggagaccgcataattccctcattcattctggatttactagcactcagagagctgaagttggagccttaatattggccttcgagaattttttcgctcaacccatcaatattgttagtgaccctgcttactctatttatttactgcagaaccttgaaacaaccctcattaagtccactctggagcccacactgtgtgcactttttgttcgacttcagcaattgctagatcaacgtacacatcctatttttatcacatatattcgagcccacagctcactgcctggcccactggcttatgacaatgaacaagcagacctacaagtggtgacatcacggcttaaccaatccacccaataacatcaattttcccaccaaaattggagaaacttatccaaacgatttcaacttatccagagagtagctacacaaattatcctgcaatgcccagattgccagctcacaggcacatcccctccttctacaggtgttaaccctagaggactagaacctaatcagttatggcaaacagatgttagacacatccctgaatttggaaaactaagatatgtacatgtgtccattgataccaattctcatgtaattagtgctcatgcctttcctggagagtccacccgatatgtcattaaacatcttcttttaacttttgcatttatggggcggcccacaaaaaataaaactgataacggtctggcttatgccagctcacagcttcaacaattttgtcacatgtggaacatccaacattccacaggcatcccgcataaccccccaaggacaggccatagtagaacatgtccatttcacctttaaaaatatgctcaaaaaaacaaaaaagggggaatatgagttaaggacactgcaacactattggcacaagccttatttacccttaattttttaaatttaaagataaatttccatcagctgtagaaaagcactttgctaaaacctctcaagacataaaacctgctgttttacagaaagttgtaaacagtaatgtatggtatggtccaaatgaattgcttaaatgggggaaaggatatgcttgtgttcacaccccctcagatcctctttggattccagcaggatgcatcaaaccataccatggcatgactaggacccaacccataccagaaatgaagaaaatgaccctgcaggacccgcagccccagacaatactgcttcctcggatgacacaagccccagacattacctgggggatgctgaagaagacaactcaggaggccgagcgaatcctgctccggacacagacaccattcactccagataatttgttccttgctatgctctctgttgtacattgcaactcatgtagggcattgatcctttttatgctctcgctttgtctgcaatctgcacctgctgcactctattggactcatcgcttagatctgcccttcttctgccccatcacctgggcagacacccccttcccagcctctaataacataactgcttggctgggagagatagatttacccctagtggggtccctcattaatggcacacagtggactaaggtgccaggtaacactacatatcactccactatcctcccactgtgtgtaagttataaaagttctaacccttactgtgtacctgctcaaacacaattttggctacattgtggcaaaggaaatgctttaacagtcttagtagcaggtagcctcaaaccaggcaatgcaatcaatgccattttcccaaacattcctccctgtgctaaagaacaaagctgggaaagtaatggattccactttagctgggaggtctgtcacggggaacaggcctgtagcctccagttaagcaattataacatcttagactggagtcctcccagccatttgcagggcgatcgtattgatgtccatgtctatcttggcatcaatggcagttttgtagccacatcccgttcccctataatttgggccgatggggggagggatatcccagaccccaagtagagtccatgccaccccaagacactttatggcacctgggacatcttagcacttcccttaacacctggcatgggacatatcataattccagtcacaattatactatgaccttttttcataatcacaccgatcagtgcctgatttgcctgatttgcactacccatccatatgttttccttatgggaaccaatatttctattacaccccaaaactccacgtttgtgactcgaatgcagggacaggcttggttcatctcttgtatcactaattataatatatctaatttaaatattgctagtgtcatggtattgaggagacaatctgaggctttcctaccggtcaatttaacatgcaattggcaaggttcctctgcccttgccaccttagaatgtgccctgtcccaggtcagacgcaaaagatttatagttacacttatagcctttatggtctcagccatagtcatcctagcaactgctagtgttgctgtagcatctattactgaatcagtacagacagctacttttgtagataatttggccagaaatgtgtctgatgtacttctcttacagcagggtatagatcaaaagattcttgcacatctgcaagcccttgaggctgacttggaatatgtaggggagcaacaagatgcacttgcgttccaacagcaattaaactgtgactgggagcttaggcacatctgtgttacctctctaccttggaatcaatcaatacatagttgggataaggtgaaacagcacctctggggaacctttcgtgataatttaacagcagacgtaaagcaacttaaaactaaaattctagaatccctaaacgccatagacctacaagcccaacaaatagccatacggaagggtatgagagaacatctctcctggatagatccccactcctgggggtcactccttgattggaaaagaacgttgtgaattatactcatgtttgccttatgttatttactaattctaggattcaaagccagaatatgagttataaccgctgtgccagacaaacatgttgctgtacacatctgtgctcttcaatcaacaaaatctgatgcaaaaaaacagaaaagggggagatgtaagagataggtcagggtggtgggagaaattataagaaggaattataggaaaaacacaagccttggaaggccaggaggttttgcaaaagcttcaaaaatttggctgaaggcagccaaagtctcttatccaaagccagagagcaaaaagcaggtaacaaggaagtgtaaaggaattgatctagatcagttagtttacttaggcccgaaacctggcctttaaccatctgtgtgcaggactgctctctctggggggcggccatgttaattacccacaagatgtgttgactcaaagcctttgtcattaaatctgtagtgaatatttgcccgcagtgccggcttgttggggccatggctgctacaactctttatgtgaatggcccagtcccctagccttctctttcactggatacctgtgtctgagtacattttttatccatcgctcggtcagcgtctgccagtcagatctggcattaatgtatgtggatattttatactctcgtgaacattttactatattaattttaaaattttgatcaaaaatatgagtgaaaaatattttctcaatgttactttaatttgtgtctctgcattttctagctaggttaattagaacactaagttaatttcttacccatacgaagctggatttatgcagtgttctaagtaagactattcctctgggcatgatttaaaatttaaaattttgaaatgtcaacatatgtttttcatttgaggaaaaaagattcagtcagactgaccaggaggcacggaaggagagcagacaggacatgctcagcccgtgaggggcattgggtggatccaggggagagcaattgtcagagttcatgagtgagaccacatgcaaaaccaagtccacagagccccaggcaggctggcactcagagctctgaatccagagttcagcccactagggacagggaccctggaacccaggggaaagaagccagagggggagggagtatacgacaatgtacaggagtagttttgagaaatctgagaagaacaatcatcagctgggttggcatttcactgtcttgatggtgtcctttgaagcccaaaagtttaaaatctttgtgaagtccaatttatctattttttttctgttcatgcttttggtgtcatatctaggaattatttgcctaatctaaggtcatgaagatatacccctatgttgttttctgcaaattttatagtaatagctcttatatttaggtcttttgttcattttgagttaatttttgtatatactgtgaggtaaggtcaaacttcattcttttgtatgtgcttatctagctgccccagcaccatttgttgaaaagatcattctttcccccattgggttctcttgacacccttattaaaatcagttgtccccagagacatgagtttatttctggactctcaattctatttcatggatctatacttctatccttgtaccactactgtcttgaccagttgctttgtcataaattttgaaatcaggaagtgtgagtcttcctatgttttttcttttatcaaggatgtttagactaaaatgggtaccattaatatttgacaaggaaaatcaattgtgggaatagcatttttaaaacattttatgtgtcatttttaaagaattcttacttttgtgggtacatagtagttgtacatctcataagtacatgagatgttttgatacaggcatgaaatgtgtaataatcacatcatgtgaaatggggtacccatcccctcaagcatttactctttgtgtaacagacaattcaattatgttcttttagttattttaaaataactaaaaactattgaccatagtcaccctgttgtgacttaacaaaatgatctccagttccatccatgttgttgcaaatgatagaatctcattctttttgatggctgagtagcactccattgtgtatatgtaccatattttatttagccattcatctgttgatggaaatttaggttgcttccgaatcttggctgttttgaatagtgctgtaacaaacatgggaatacagatatctctttgatatactgatttcctttcttttgagtatatgctcagcaatgggattgctggatcatatggtagctctatttttagtttttggaggacccttcaaactgttcttcatagtggttatactaatttacattcccaccaacagtgtatgggagttctctgttctctacatccttgcaaacatttgttgttgctgtcttttggatataagccattctaactggggtgagatgatatctcactgtagctttgatttgcatttctctgatgatcaaacaggcagagcacttgttacatgcttgtttgctatatgtatgtcttcttttgagaactgtctattcaaatcaataaggaattctctataaatacatatatgtgaatatatttctagactctctctttagttccattgacacatttctattgttatgacaatactacactcttctgattattgtgactttataataagccttgaaattaagtagtgtaacccatgcaacttttgttgtcttttttttttaacttattacactttaagttctgggatacatgtgcagaacgtgcaggtttcttacacaggtatacacgtgttgttgtctttttaaaagttattttggctactctaagttctttgtacttatacatgaatgtgaacaccagcctgtcaatttctatttttaaaaaagtctttcaggtttttgatatggattttattgaatctatatatgaatttggaaagaatgtacatcttaacagtagtaagtcttccaactcatgaataagatagctatctccatttatttaggagacaaataccaaaataaactttatttaggcatttatccttcattaatttatcactgcaatatttcttagtttttggtgtacagatcttctacatatttcatcatagttatgtctatgtatttcatgttttctagtgttacttttattttattattttattttgagacggagtttcgctcttgctgcccaggctggagtgcagtggcgaggtctcggctcactgcaacctccatctcccaggttcaaatgatcctccagcctcagcctcccatgtagctgggattacaggtgcccgccaccacacactgctaatttttgtatttttcatagagacggggtttcaccacgtcggccaggttgttctcgaactcctgacttcaggtaatccgcctgcctcggcctcccaaagtgctgggattgcaggtgtgatccttcacgcctggcctagtgttacttttaaatcatactgtttttaatttcaatttccaatttctcattgctagtatataaaatagaattaatttttgtgtattgatattttatcttgtgaccatgccaaattcaattattagttctagaagcatttttattttagatttgtacaggtttctgcatagactaaagacggttttgcttttccctttccaatctggaggtctttttctttcttcgttgcactgagcaacaagtataatgttgaacaaccactccacctctgtgaactcaaatgtcttaggttgtagtttcctgcatgcaaacaccccgcacaacttctggcaaatgaatatctccctcatccctcctgttaaaacccaaatctggtactacacagactgagatgaacacaatgcccatagttgaaacaagactaataagatactcagtagaacaaggctgtttacagcatgagagcctgacagcctgaaggcagcgatttcagattggaaaacagaaaactgaagggacctctatggacactaggaaaagaatgcgggatggaacttttccctgacagtaaccaagaagtgagtggtcttcaagttacataggataaatttttaggagggaagtgggatgattcacatctctgcatacagctaaatcggccatattaccttggagggatttttggtaagatgtacaaaaattagataatcgtgaagggtaggagagaatggagtgagccactcaatgaggtggccatgggggaaggcttggagggaacactctctccccacgatgtgacccaccagaacttaatatggggagatggagagggtagcaggttagtttggatggctgtatagggttgctaatgaaatgctacgtttctccaaccagagcatcttggccccctcactgccacccctcccccaccatcaccacagaggtgtcaggttggtgctttgtatatttaagccttccagagccaccactggatgggtagtggctctctgactagtcaaagcttagggatgtggttcgtcattgtcctgggaggggtatatatggggaggccaggtggcctggagtagaccattgagagacgaggacaaggtgaagatggccaagaaaccataagcctccagcccagttgtggaacaaccacctgccaacaccaaagaggcgaggaggaggaagaccccttctcaatcaaggtccagaagccctatcaaggtgaggaacccacccaagctcctcctcgtcttccccttgactcctccctcccaagacttctaccctatcctggcctgacacaaccccccaccccagcctgtatcccttctcatgaaacccgtctttccatccctcctccatccacttccccaaaaccaatgcctttctgtgatctccttgttgtcctttcaggttcccaaaccagcaagggaaaagaaacactttgatggcgttccagaaaagaagcctctcccaaaatgaccactgcttgaggaaaactccaggaagggagtaggccaacactaccaggccaccgtgaccagctgaatgaggagctcaatcaaaacgagccacagcgggaccaaaaccatctccagtgtgtcccctgggcagccagtaatttcagggcaataccagagacctgagatctatctgcaaagtcaccagaggtctagtccccagagaaatagccaacaaggtctagggtacattttatacccagcagggcatgctccatggtgatgaaaattaaatgactcatagaacagaaatatataaaaatatatgttgaatgttaacaggtattttcacaggtttgacttgtttcttgatagttattcagacactaggggaaggtaaataaaagtaaatgaaataagcaactaaatgagacctaataattggcctttgattttaaatatttaatttgttattataaaccttatcaataacaataaatctaaatcaaaaaagaaaactaaatgagtctgttgtaaactgatatgtgtgtctacatgttctccgatggtggggagagaggaaggagggaagaggtagtgtgtgggaagagatggaggtgggtgttgcccggttggggtcacatgggcaaccccagccaggttgattcacagttagccaagcacataggagaaggattgggtcggggctgaattctggagacaaatttcctccttaacacattggcccatgggagaagaggaaaaggttggtatatccgtgtgtgcttgcagggctgtggacccagctggggagaggagttatgtgtatggttccagcgtcgccccccataaaaggcacacaaagtaattgccctcataaaaaccaaaaaccttcctactaaaaatcatgaacagcactctgaagcactaaattaatggtgtttggacattgaaaatccaacactgattcagcaacactctcgcttaaaaaatacctttggaatggagcagttggctaccaaggatggggtgtgggagtggctcctcccccgtgcaggcaataaaggggagcattgtctacatattattattcaagttcaatttttatttgagacaattgtagactcacatgcagttgtaagaaataatacagatagaccctgtgcaccctttatgtaccttcctctaatgataacatcttgcaaaagtgtagtacagtatcacaattaggatattaacttgatacagtcaagacatagaacagtcaccacaagggtccctcatgttgcccttttatagccacagccactttcttcctacaccaccttctcctcctcaacccctagaaacaccactcatctgttctgtatttttatcattttatcatttcaagaatgttatttgaatgcagtcatacaattatgtaagcttttggtactggctttttaaaaatctggcatgactgtctggcgattcatccagcttattgtgtgtatgaacagtctatttcttttcattgctgagtagtattccaagggacctggatgaaccacaggttttgtttgtttgtttgttcgagatggagtttcgctctttcacccaggctggagtgaagtggcgtgatctcagctcattgcaatctccgctccccgccgggttcaactgattcttctgcctcagcctcccaaatagctgggattgtaggtacccgccaccatgcccggctaattttaaatttttagtagagacggggtttcgtcatgttggccaggcaggtctcaaactcctgacctcaggtcatccacccgcctcggcctctcaaagtgctaggattacaggtgcgagccatcgcacccggccagcagttgtcttttaaaccattagtctgttgagggacatctgggctgtttccagtacttgcttattaataaagctgcagtgaacattcttgtacaggatttcgtgtgaatataagttgttagttttctaaaataaattcccaggtgtgtgattgctgggttgtttgttagttgtatatttagttctagttgttttttaatgaataggctttattattagaaaaattttggactggtagaaaattgaggagatagtacgtttcccatatactccttttgtcccctgtacaaagttttctctattattatcctctgctagtatgctacatttttcacaattaatgaactagtatcattattgatacattgtttttaactaaagtccgtagtttacatgaaggttcactctttgtgttgcaaggatctttgggttttgacaaatgcataatattgtgtatccaccattacagtttcaccacccaatgaatatgtgtgcttcacctatttatccctcccttgctgcctccaaaactctggtaaccactgatctttgtaactgtctctccagcttgccttttctagaaagtcatgcagttggaatcacacaatatgttgtcctctcagaccggcttcttcactaggttcctccgtgggttttttgtttgtttgtttatttgtttgtttttatcgttgttgtttacagacagtgtcttgctctgtcacccaggttggagtgcagtggtaccatcacagctcactgtccataataaaccttgaactcctgggctcaagaaatccttctgcctcagcctcctgagtagctgtgactacaggcacacaccaccacgctcaactattttcttaaatttttgtacagacagggtctcagtatattgctcaggctggtcttgaattcctggccacaaacgatccttccaccttggtatcccaaagtgctgggattccaggtgtgactcatcgtacccgacctgacttatttttattgataacatttcattgtctgtaagtaccaccgtttattaattcattcacgtattgagcacctcttggttgcttccaatttttggcaactatgaataaaggaatttccactaaaggaaaacgcttgctcacaagtagagatagaatccaggcaaaaatctagtccactactagttcatgcagctccagaggcaaagaggaaatgcggtttgtggacaagttactgttggaagaatgatggtttttgatgacagctgcaaggtacacaagcccattctgtgataatagctcaaatgaatgcatcactttgttagcttccagctgcagatgctgagccacagcttctataacccccacccagaaacctgctccccagagctcttctgtaaagctgctggctccaggcatgtccctcatgcttcagggtgtggaggccctccagggctggctacaccggggtcctgagttggcctaagcttgtggaggaccagagaggttgtgccaggcagaggcttaatatcacctttcaaaattaaacaagaaaatatctttttattggaaatttctggtttctggtctggcatataaggagcttagaagtcatcactctcatcctcacaacaggaacagaaactgagcaaagcagaaatcagtaactcttctcagattcatcggagaactaaggtcacagagcaaagcagtgcccccaaaactggagagctagacaggtggatacagagaatcacagcttactgaagcagaagcccagaaacagaaatcacttttggagccagtaatggtgcagaaaacttaaactgtaactgatgaactgctggaggctcagtgtggacaaacttgagagttaaagtcttcaaggttgcccagtcttaggttgttgggttttttcaaactttattgatgtataatttacaaaccacaaaattcacccatttgaaatgtacaaatcaatgattttttaccagagttactaggtcatgcaaccatcaccacagtcctagttttagaacatttccatcacacaataagattcctatgcccacttatagttaattcacgtgcccagcccactccatggcaacaactaatccactttctttctatctttaatgatttgcctttactggaaatttcatataaaaggaattatatcacatggcttatttgtttaatccatgctgtaccatgtacctgtagccctttcctttttactgttgaacagcattgcaaagatgcagcatatgttgcttatccatctactagttgatggacatttggattgttgtaacttttcagttactgtgaatatgcttcgatgaacattcctgtacaagtctttgtatggacgtatgtttccttttttttttttttttttttaatagagtcttgctctgttgctcaggctggagtgcagtggtgcaaacatggctcactgcagcctcaacctcaacctcccagattcaatggatcctcccacctctgcctcccaaggagctgggactacaggcgcgtgtcacaatgctgggttaatttttgtatttttagtaaaaaggaggcttcaccatgtgcctcaggttggtctcgaattcctgggctcaagcgatctgcctcagcctcccaagtgctgggattgcaggcatgagccaccaaatctggcccattttcttaattgtgacttttccagtaaaaaaagttttaaattttgatgaagtacaatttgttgattttttttcaaaagtgtgctttgctgatgttaataaaactttgcctaagccaaggtaatgaagattttctcctatgagttaatttttctaaggtctgctataaaggtgcaaattcatatttttgcaggtggatattcaattttcccagtgccattcgttgaaaagactattccttcccccgtggaattaatatgttagcacctttgttaaaaatcagttgatcacaaggatatgtgggcttatttatagacttttaattctgttacattgatctgtatgtctactcctataccaaaaccatacagtcatgattactatatcttgaatcggcaagtaaatgttctccagctttttttttttttttttccaaaatgcgtgtggctattctgggtcttttgcactttaatataaattctagaactagctagtcaagttcgacacaaagatctgctggaatttttataggtatcatgtagaatctacacatcattttggaaagaactgacatcttaacaatattgcatctcctgactcatgaacacagtgcatgcatctctctcattcagattcccttgcactcctctcaagaatgttgtttagtttttagtgtataagctgtgcactcattttgttagatttcttcctaagtattttattcttaatgcaattattttcttaatttcactttgggtttattcattgttagtatatagaaatgctactaatttttgtactgaccttgtatctggtgaacttgctaaactcattgaatagttctaatactttttggtgggtttgttagaattttctgcatacaggatcatgtcaatgaataaaatcaattgcactttctttcttccaagttgggttaacattaacaattcagagttcactgactgcactcactcctgcatgacacggggtctctatcctcttgtaaacatgactcagttgttttttttgttttgttttgttttgttttgttttaatttctggagctgccgcatgtgtgttcatgaatagcgctctggtgaaatttatactttctcccctagtccagaccctgggaagccatgggaggtcagggcccacagcatcacctgtggtcagtgaattctggagttggtgctatgcagatgctgtctacagagtctctatttcttgcaatttcaccccaaactggaagctttgggccacctgcccctttgactacggaagtggcacttaaatttcaaaagcaagatggtcacaatgatcataataagcaggaaacttgagtggcaaacagggaatctcatctgcagagaggagcagactctgttaacagaacacagtgcttttagagccaagatagaagaacagacaacaagtatgttgcttaacttatatacccacatgaaatcgaggctcaataagcagtaggctgggtaaactgctccaataaagttttaatccatctcccagtttccagacctgagccaattctcagacacagaatttattaactgaacataacacaatggtagagtcctcttgaggaaaccacctgcaatactatggcaagttgatacaatagtggttttccaagcccagtttccaaaggaacctatgtctattcacctcagtaactgaacactgggaagggggaaaacactcaaacatttcaaggaccgctggacacagaatctgcattgacactgacacctaggacctgaagcttcatcatggccccctgtttgttagagtggaagcaaatgtgggccaggaataaatggagttcttgcctaggtctgacccagagtgcccatttatccagtttccaaatgggaaattgaaatggacttcctcgataatgggcacaaaccctgactgggtccgtggctgttagtagaagagctagcagagtagagaaggccaagtgcacttcctgcaccttggccatgatagtaagtaataaacaatattgcatcctgagggatggaaaatgttaatgacacccttaatacctaaaggatgtaggggtggtgatccccatcatatcttaatttaaggtagcagcctggctcctacaagaacctgatgggtcactgggactactgcaactttgcactactgcaagctcaatggcaagagccttaacagatttgttatcttcactagaacagatcaccacggcctcaggcacatggcatgtcgctactgatcatcatgagctaggttctgtcagacccacaaagtcaggtgattccaaaagtaatctgtgataagatagaagtagcatatccaggaccagataccagcacggccatagattacaagcaggtgacctaatccccaatgtcatctgccactgttgtgtctgtgtctctccttcagctcttttttattcctatagattaatggaccaggaagttctcttatgaccagctgctggaggagtagaagtgctgagcttagataatagatggtttggccggatttagagcgcaacctgaaaatgaacttctgttgtaatactacctcaatcgtatgtggtcaagaaatacattgttgagcagaaatccccaggtggcagagcttcaaatggtgcatctgatgatccacttcatatctaaaaaagaagtgacccaaactacgaatggacttatggacagtgaaaaataaattggacagctgctcagggacttagaatgagaagtagtgacagattgcaataagcaggattggggacggaggtttattgatggacgtatgagaagggacactatatgtgaagatatttgtatcacgtcttaaggctcaagagagcattcaccatggaagagacactaaacgtttaatcaagaaaaaaatgacctaactagttgacattagccagcctcagccgctggccacattaatgctacacaatggccttatgtgtgcaatagccacggtggaagaagtggatgctatgcatgtgttcaacagcatgggtccccattcacccaggcatatccagctatttttgccaaatgttcaaactgccagcaacagaggccagtgctgaatacccagtagggcaccattacttaaggagactaatcagccccttgtggcttgttgattgcgtccagcaaattccatcctggaaggagcagagattcatctttactggaatttgtacacattacaggtataagtttgactttcctgctcacatttctttgtcgggcaccactaacacagggcttaaagaatgttggatacactgagccaggatactccatacgatcagctgggaccaagggacccacatatagcaaaggaagtgctcagtgggcacatgaccgtatgatctaaagttgttatctcatactgcgccacccaaaagccactggtctactggaataatggagtggcttcttcacagtgcaaatgaggtgcaaatttggagatcacagccttgaggatggggtgtcattctctactgtactgtatataccctaaatctattaccattctcttccatcaatagatagaatacatgatgcagataccaaagggtggaatgacctcacttactgtcactccctgtgacctgtatgggaatttgtactttctgctacatgagtttaggttctgtagttctagaactgtgctttccaataaggtgtcactagccacatttagctatttgcacataagtttacactatttaaaattaaatttaaagttcaggtcctcagtcacactaaccaggtttgtatactcaatggtcacatgtggctgctggttaccctattggacagtgctggctagatatattggttcccaaagtaagattacttccacctggaaaaaaacaatttaatgggactctttccattaaatttcaagctattgctcccatctgggcactttgagcttctcatgctataggaccagcaagcataaaaaggagttgccatgcttgcagggatattggctctgatcatcaggaggaggtagggctgcccttatacaatgggaacagagaggaatgtttggctctcgagtgaccccttgaatgtgtcttcgtagtcccctgccagatttctatagtatagggacaattgtaagtgccacagcctgagaaggtcgtggaggaccaggagcccagaaccttccgggatgagggtttgcactactctattgggtaagtaatagagaacagcaaagattctggttgaaaccgacagtactctagaatggatagtagacaaggaacagaattatcatcagttgtggcttagaggccagctgccacagagggcctatcgtttgtacactcttctttctcatgtgaacttctttagtaagagatcaccagaatccttgaggagttgtgctcaaatgaggtgaactttctacatgaaaaagtagggttaatccactgcttggcatatacccaaaagaaaggaaatcaggatatcgaagagatatctgcactcccatgtttgttgcagcactggtcacaaaacccaagatttggaaacaacctaagcatccatccacagatgaatggaataagaaaatgtgatacatatacgcaatggagtactattcagcaataataaagaatgagatcctgtcattcacaacaacaaggtggaactggagggcattatgttaagtggaataagccaggcacagaaagacaaactttgcatattctcactgatttgtgggagccaaaaatggcaacaattgaactcatagagacagagtagaaggatggttaacagagtctgagaagggtagtggagtgtgggggggggggaaggatgtttaatgagtacaaaaatatagttagattgaatgaatctaatatttgatcatacaacagggtgactacagtcaaccataatttattgtacattttaataacaaaaaagagtataattgaaatgtgtgtaacacgaagaaaggataaatgcttgaggtgatggatattccatttaccctgatgtgattatgcattgcatgcctgtctcaaaatatcccatgtgccccataagtatatatgcagctactatgtaccgcaaaacattataaataaaaaaaatagaaaaaaatgtaggtttaactgttgcaagagaagatggactgtagtggatggtatagtgctaccaagatctttgctttataactgaggcgctcattcccccaaaggtattgtttgttgatgaccgataaccagggtcctctccatggacggccctcagttgtaggaaacttcctttccggggtcagcttccttctagtgactagtcaaggaatcaatgggaggagtacgaagcccccatccccctgcttcgtatggggttacttcttcaaggctatcctggttgctttctgttttcaaaaattactgtaactactgtgctccgaaatgacagcagaatgaagtggaagttagaccctgagatatcaccactattggaggcttaagccatgggcaggggccatccctgtccgctgtcgggaactctaaaaatagactcctcaggaatttgacttgggctcaatcaaaagccagaatctcaagcctactgtgtcctgttacttgtttcagcaaatgagataacctctgtggcccactgaataaactgtaaagtactagtgagaggatgctattattgctgtcacagcaatagttctgcatcccacagtaagccagtgtggtggataagaactgagctttgaaatcaaaacacctgttatttgagagctccactgaaaaaatgcctgtgacccaccccgggctgcccagcactgcacaatgatggcagaagccattcaggatgtgaaggggcttcaccaggactggacactaggaggctgcagaaagtaagaacatttgacagatgcaacagcaccctctggagcacccgaggatcaggggaagccttaaggacgaggataactgtacacagttgacagatcatttactgtgccaggcagtgggataagtgcttcaagttcctcacagccccgtggaggacaagtttcggccatattttaccaaccttccacgagctgtcttactggatcctgaagccgcacacacaccagtgactactgaggtcaggagttgctgatttaataaacactcccatgacacttactatgtaccaggcattgtttatgtgcttgacagatattacctgatgcagtccttatatgtgcttcgtgaagtacatgctactgctattcatgtttgacagatgagggaactgagatacaaggagtttggaagctcgcccatgatcacacaactaggaagtggcagcgccaagactcatatccaggctggctgggtccagagcccctgcttccagctgtgtcccttaaacctaagtccggctaaactattctcacttggaaacaaacatgtttctaattgtacatttgtgtcctacacacaccttggctcttctgaaaccatgcagaaagaatctactaacccagccacatacccctattagatcgtgagcacctcaaagcaaggtttgaatgccatgtttggaactactggtgcccgtgataagccttagcgcccactgggagatcatgatatatttattaaataatggtttattgaaaaatcaaataatcttcttggatcaactttatctggcttccaacacatgcaacaggcttgggccctggtatgtcagcatgtaaggatacgggtgaggatgttggatcctggaaatgactcctgaaaaggccgtgcatgtgggagatggggaggtacctgggatgtccttaactgcctagggcaccactctccacacccactggctccctccaagaagggacatgtgatgtcgctgtttccggtaatgtcctgttccatcctggagcgcccacaggggtctgacccaggccattcctgggagcacccacctaatgacctggtccagggttccagctcacctcagcctccttctgctcccatgtccctctccccacagccggcccagggcagtacagctggacctggcaggtgcttctcctcacgcccctcctggggtggctgatgctcagcacagcctaatccctcaggaccccaaagccctctcacacccagctgctttccaagtcctaacgtggatctgggagtattctgcggactgcggagtgtcccgatactcaacgcccccaccatctgctacagcctttagtcttctttagctgcctgtctggggataccgaggccctagctgcctctgctaggacaccccagccccacctctctggatcatcagcctgagaaagcaaaacctcatagtcacccatttaaggtgatcggttaatcaaaagccagacattacctggggaattatttgaataatatctcctaatcatcgtgatttgtcactcatcatgtcagaatgcttattattcactaggagcctccccaaaaggcttcatcatctcctgccagttctgtcaccacaagaccttggaaggagatccttaccagggaatttatcacaatgataatcgcatatgagcatcagctccaggtcttgagcagtagttagtggggagagaggaagcgcaaagccccaagctgggcagactgaggcccgattggggcagtgtggacacagcagcaggggacatgagaacacaactatgggccccaggagaaggaaacttgcaatcccaacaagggcatttgactgctggctgccagcctccaattcaaggacacatcgtggctcttaaaatactgatgggtcatgcttcagggcccaaagggtgcagatggcaatgcaggaattcctgcagtcagcttcctacggggtgttgcttcctgtgaagacctccatccctgcccagggccttcaaagtacagaatctggcatctcgcatagaagggagcaaatgtgtatgacttaagtctctggatgtgttctcaggatgtgagaatgaaacccaaagctcccgagtctccttctatggaatctgcctcacatagcttcatgagccccagcttcttgcctgccatcccctgaggacctggtgccagttccccatctgtgtcactcctctcctcacctgaccagatcctgtcacatggctaaaggagggggaagagaatgcttcatctcagaaggagggtgagtagtgtgctcttcccatggaggtcatgtcattcttgtgcagcctcaaactcctgcactgctcccctgacctctccctggagggttctgcccactccacagtccctcctgctgtgctcccaaaccccagtgtgtatctccagaacatgtctgcaaggacctaggcctccaacatactcttccttcttccccatcttggcatcaaatctgtcttggaggactctaggaatactagtctgatttttgtagaacatccctcagtttcagtgggtctaatgtcttctcacgattagaagggcatgcatgattatgcattattaggaagaacaccacggaggtgggaagccctttttatagtgaatacagtatctccagcacttaggtcagtgcctggagcatatgaggagctggataaatattgaatgaatgagcgaatgaaatcatgttttgttacctcttggagagtgtgtaatgattcctcaaataacttcacgcagcaaggaacggtgtgtacaaaggcagggatggcacctgtctactggcattggggagaaatcatgatggagcattctccagatgaatgcaaccttgcaaaccacgttggccacccttcctactttctccagggaagtagcatcaaagtcattggcgaacatgggacttctgtctagagcttgtccaggaatcaatgggaaagtgttacttgaactgaatgttacataaatccctttaaggcccagctgaaacccagagacatgtgagaccttgacattggctgcttgcagacccaaacgaccagagagaggagcagggaattgggacaagggccacagctgcctactggcaagagagagtgctcagatagccactgatgtttgtagccctgccttgctgacttccccaggatgccaggagcacagaccaggcgctggggcagcaggtctctggagtccctagagctcagttgcttacctgttccatgactcaacaataagagggtgctgggatgcatttaaactttgattgctgggtaattgggaggactgaaaatgccacgaggctccaatgcagaggctgcgaatactaggaccatggagctgtagttcttcatgcgtcccacagctgagtactgagcatgtactgtttgccaggcactgctctaagctctgaggatacagcattgaacaaattccctgcttctgtggagcttatgttctagcgggaggggaggggcaggcacacaatgaactgcggaacaaagttacaggtgaagtaggttttatggtgacaaacgctatggaaacaaattgaatcgagagagctaaataaggagtgctggaaattgggtggaaggagggattgcaatttttacaatggtattcatagaaggcctcacagaagagatatctcgagagagaaccgaggatgtctgggaaggaatgctaacagtattataagagcaatcgtctagaagagaacaaagacatgcagtcgctcggggccttggaacagagtgtagagggcagggtctagagacactggtctggtgagccaggtaaagggtattccctgatcctctgagccatggactgcctcagagccaggtcagctgcactgtaccatgaactggcttcttggatccaggtttctattccaggttactgacttgacctgaggactgggtacagaatacaggtctaggtgtccagaaacctttctctcgggataaaggggatggaaggcaccattggcattgaacaggcaaggctgttggcctgctgctgtggcactgctgcggcgggcaggacaatggtgcacgtgtaaagactgggtgcagaacaaagcagaaggctgtctggtgacacctagtgctcattccagagtagactctgtgtcttcaatgaggggccagatgtcttaatccaggactggatttcctatctttcaaagttcacctcaggtggaggccagaagcaggtttggctttttgttgggggggaaggtacacataggaggctctttgtgcttcctactgtactccagcaggaggcatacaacttctggctgttcaacccttgatcatattggctctgatcagtgggctcaggtggagaggtggagacagccttgttcctccattgcagagtgcgtcatcaacccttcaacaatgtttcatccattgattagcatggattgcatcagttgcattgctggatattgcaaatacttgttttccttttctctcatatgttgcattttcctcagctggaattctccagtaaggaagaaactttcctcatcaactgtagctattgtgtcatcctgaaatacagttagtacaggaaatgcaggataaatgttttattctctctcttgcagagccaattctcaatgtgaggggtggttattcttgttccttccaatggggtccaacaagtcattctttattaatgactttttattttagaaaatgtttaggcttacagaattattgcagagatagtacagagaattctcatataccccacacccagttttccctattaccatcctcttacattagcattacacatttgccacaattaataaaacggaagacaaaaacaaggacactagaggaatctgaagcctctggcatctataggtataagaaataaagcccaactcccagccaaattgacatacatcctcactgtagagatctaattgcctctgttcctatgacctcatacaacacgttcactctcaacaaaaggattgcaagggacacacgcaaaagagtaagaaaatacatagtctgaagagacaagacaatcaacagaactggactctaatatgactcagatattggaattaggaggcagataatttaaaatgactatttttaaaaatttaagaggctttaatggaaaaagtaggcaacatggaaaaacagataggtaatgcaggaagagaagtattgcgctcagcaaaatccagagtatgggaaactggacagaacacaaggcatgtcttcattttcaacaaatgagtttcaaaaaaaggtaatgtgggggaatctataaattacttaaggtggctattaagaacataaacacaatgtatagatcatatttgcaaaccgattcaaagaaactgcattttaacaggagcatatgtccaccagatacatgtgacaaataagtgaacatttcattatattaatgacttgcttacatgtttaggaaagataataatgttggctttatgttttataagagagtagttatctttagaaatgcactctgatgtatttggagatgagatcacatggtgtcttggatttgctccacattatttcagtttctgctatgcggagtaggtaggggtataactagaaccagattggccatgagttgaagattattgatactgaaagtctggtatattagattaattatagtatttaccctattattaggtgtatttgaaaatgcttgtaatgaaaatatttttgaaataaatatgatatttaatttgaaatcctaagtgaaatggataatattttaggaaaataagtacatgaacaaattgatacaaaaagaaattcaaatctttaaccaaacaataaaaagtgaaactaatctaagctcaagccatcctcaaatgtggacaaggcagcttcggaggccaattctacattgttatcaggtaaagctcaaagccaccttaagtaaactcttccaaggcatacgaaaagttgggcaattattcaaattattttcccaagctaaccattcttcattcaggtaccagaggaggacagcaccgtgaaaacacttgagccaaacttcactcacacagaggcaaatatattaattaaattagtagcatattcaacatagaagtgaattaacggattgtgtccaaggaacaaaaacatgatttaatataaaacaattttcagttgtgatttcctacgttatcgaattaagattttaaaaagtgatcactttaataggtataataggtacagaaaagattctggaggaaattctacaagaggtcatggtcaaaagttttagcaaaatgaggttagaaggaaattagcttttcctacgatcactggccagcatacccaaatatgaaatgtcagaagaattattgtcataggactatgctataacctctatctttggaaattacactgtaacataaggccagagaggtggatatcaaaaaaaatcagtataaatattgaacagatttaatatttggtacgacaatatgattatctagaaaattcaaagaattgtgcagatggaatagtcaaataacagacttcagaaaaatagtatacagaagattactacagtaaaatcaaaatccttgcaacccaaataaataactattcagaacaagtaatagaaaataccccattcacaatggcaacaaaatctagaaattatccaatggagacagacaaagcatacaagatctttatggaaacaactatgcaagtactgatagagttaggtcaaaaagttcccagataaacagagccgtattctatatcccttaatagggaacagactattgaaaagatatcaatttttcttattcaagatttacagatataatgcttaaaatttagctgccaagatgaatgtcaggcttggacttctgccctcaactaccaaaatcaatcctggaaaactatagaagaaagaataaaataaaataaaaaaacaaatagtatcaacaacaaaatctaaacaacaaagcaaagccctgggggagaatgaagactgtgtttaactggtacctgtaatcgaaatggccagagtgtcaaggaagttagggagagtccatagctggcatagaaggaagatgacaggatgtgtagaaggaaatgtttaaatttttgcccctattccagtgtgaaaatgtcaggtggcacctgagaccacgggtgccagtagtctggtttcattgaaacagtagtagctccagtctgtgctaataaccacctaaaaccacattaataggtgaattggcttaactgaacataaagaatggattacaaatagagtgttgagcattagaatgaaacaggcataatgaggttaagtatgatttctgatgctgaatgaaagtttaaaaatgaaaatcactgcactgagctatgaaatactcgataattctaatggcaggaatccccaaatttcatgctgctgctcagcctatttaatgtaaaaacaaatattttaggaaaacaggtttgcaaactcgacctgtggctggggaagagcttccttgggaaggtgtgtgtcttctcccagaggtcactacaatcacagaagctgccgctctgcagggagtacctggcctgggacccgcagccattctctgcaagagatgcagctgggcaaatgctcagaagtggcagaaacagagtatctcctgcccatggcttcatcaaagatccaagagccaggaggaggatcctcttgagtgaggactgagagtccaccctccccttgtagaggaaccagagaatccagctcagccccttctaacagtcctggaagatcctggcaatgttgtcgccctgaacacacgcctcccaccactgccacctcaggggactgggagtcagagacttggtgtgaagggagcagacccaattggcagagggcagggtgtccaggctctgcaaggaatcaatgtcaggaccctaagggaagcttgagggcccctataaccattcctacccccatgcctggaagaatccagttccgctgctgctgtcgacccagggaagccccaggcttgggggccggatgtcacgccactgacgtggcctcaggggtcagaggatagcaagagcgcctcgctctgagtggcagcttgagattggtggagtgaaacaggccccggctctgtgaggaggcaaggtgagacactgaggaagactgaggatgcccctaccccagagagaggaccccaattaacccagtgccacccctgctgccagccctgggccacctgggggcagacttctcaggctgggccgctcccggctccactgccacttaagccgcagggcattctggagacagagcttggtgtgaccagggaaaggctgattaggaaagggcaggacccatgctctgcctgccaggcatcatggtccagaccctgaaggagggctgagatcccacagagcgaggctccatctctgctgtcagccctgggaagttccgggcatggtggacaggcatgtggatcctgatgttcacatcgggggctgatggagggaaggggcttggaatcatgagcacggcctcaggggagcagaaggtgggtccaggccaggctgggagacaaggcaggcctgaggggacccagcaacccagaacagggggcctactccacttctttctgagactgaggcaccttctcaattggccttgggaatttgagggatatagattcaggtccacaaaggggtgaggctcagccctgacaggatcaagaggaggaagaagagggaggactcagaggacctcgaccctgggaggtcctgggagtgctggctgtgtgtggcacatctttgctgtgtctttggggtgccagtgacgagaggggtgtaatatgaggagtagggcctcaggccagcaaagagagaagtcccctagagccctgagagaggactcagcagacctgttatcctggacctaggaaatctgcctctgctatcagtcctgggaggcccaaggcaggcctgtggagaagggacatggtcccccactttctccttgggggtcccaggaagatggtggccttggcacacaagactcatccacagttgagcaggagcgaaagggctgggccctgtcgggaataaatctgaatacctggaggaacgcagacagaggaggcacccctgaaacctgctccttctgtcagccttgggaatcccgtgcagaattttccgtgtggtgccccctcacttctttctcccaggtctcagagaggtttgggccttggtctgaggcagtgtcctgaagtcatacagcagaggaggcccaggtattgccagcaggcaaggtgaggtgtttactttaaatgtatacaaagggctccaccggccccagagcagaggggactccaaagtgccaacccacctgtcctactgttattgctggagccgtggcttctgctgacaagctgcaccctgaggagccctcttgttagtggtggcaggtacccaagttaccctgagttactggtggtgtatccatataggtctgcggcaatttcagttcttacctcctcagaagaaagaattcgactgaggggccaaaggcagaaggaaagactgaggcaaaaaacaaacaaacaaacaaacaaaacacaaagctttagaacagtaaggaaaggaaggaaaggaaacaagaaaagtataactcggaagagggccaagtagtcaacttgagaaaccaaagtcacagcttgacctcttgacttggggttttatgttggcatatgtattagttttcacattgctgataaagacatacccaagaccgggcaatttacaatagaaagacgtttaactggacttacagttccgtgtggctggggaagcctcacaatcatggcagaaggcaaggaggagaaagtcacatcttacatggatggcagcaagcaaaaaaaaaaaaaaaaagcttttgcaggaaaactcccctttataataaccatcagatctcatgagacttactatcatgagaacagcatgggaaggacctgcctctatgattcagttacctcccactgggtccctcccacaatgcgtgggaattcaagatgagatttgggtggggacacagccaaaccatatcagcctacttcagagatcttgtgttactttctccccagtcctgagatcttgttgggaagctgctgatccatttcaggtgttttctattaggagactgccttcccctggcaagggctgtgaacaattattactttacagaaatagttaacaaccacttgaccatcgcctaatggtcacccaacattcctagtgtgtgtgtgtgcacgcacgcatgcatgtgcacatgagtgaaggggctgggggaaccctctccttccctattcatacctgactagctacccactgtaacactctcacttcctccaagttctcggtgaacaggccagctaggaggataggtgccccaggaggccccagaggagcaccaaatgaaaagatccataagtctgcttttgttagagcctccaaggttcggctctcagctgaggtccctcactggctccctctctcctcaggcctgtgggtcccacttgcccagctcctgcccacactctgccattctgaccagagtcatcatgtctcctgagcagaggaatcagcactgcgagcctgaggaaagccttgaggccgaaggagacgaggctttgggcctggtgggtgtgcaggctcccttggctgaggaacaggaggctgcctccttctcctctcctctgacagtgggcaccctggaggggctgcctgctgctgggtcacctggttctccccagagtcctcagggaacctctacctcccccactaccattgacaacactctatggagccaatctaatgagggctccagcagccaagaggaggctccaggcacctcaccagacccagcagacctgaagaccttgttccaagaagcacttgatgggaaggtgactgagttggttcatttcctgctctacaagtattgagtcaaggagacaaacacaaaggcagaaatgctagagagtgtcatcaaaaattataaggattactttcctgtgatcttcaagtgcatgtggctggtcttttttttttttgacatgaaggaagtggataccactggccactcctacatccttgtcacttccctgggcctctcctatgacggcctgctgggtgatgatcagagcaagcccaatgcaggcctccagataatggtcctgtgcacgattataatggagggcaactgcacccctgaagaggtcatatgggaaaccctgagtgtgatggggctgtatgctgggaagaagcacagtgtctatgggaagcccaggaagctgctcacccaagactgggtgcaggaaaactacctggagtaccaccaggtgcccagcagtgatcctgcacactatgagttcctgtagagtccaagagcccacactaaaaccaacaagatgaaagtcctggagtatgtggccaaggtccatgggacagatcccacctcctacccgtctctgtaagaagaggctttaagagagggggaagagggagtatgagtacaagttgcagccagggccaccaggtggcaggtttagggacagggccagtgcaagttccaggggcacaacctaccccatgtgaaatcaggccctttcttcaccctgtatttgaacagagtagtcagagttcttggtaagggaggtcaaggtgggtggaaggaaacacattgcataccatctttggcttcctgttctattgagtgattggagatttatctttgtttccttttagtaattttcaaatttgttccttttaacagaagatttaattagttttaacatctaagtttatgaatgatattaatcacacatgtatttttactaatccatttcatgtataagagtttgttattttgtaatgttatgggacctttggggtgtcatttttctggcaagaaacctctgtggccagtggcacctttgcctgaattttgcttgggcctgttgggcttgttttgaccattcaacctggcatgctgcactcagctcgcactaccagtctgtgtccaattcccgccaagggcgagtcaggcgtggaatggtgagggttgtgtgaatgactgtggggtccagccactgcacacagtccgacatgccagctgctgcagtggggcaggcagctctaggcactggcacaggtgttggctctccacaaacctgcagctggaccaggcacaccacaagcagcttccacagctggcactgcagaacatggtggcacctagaagcttggagatgccaggaactgcaaggccccaaagagggagtcacagccctggctcagggagctcccaggtctgggctcccggatgggccacaggtcttatctccttctctttgctcgcaacatggtgagcaaggggcatatttcagtctgtttgtgttacagctctattagctcagctattcaatgggttccaagttcttgtcctgtgaccaggaagaatgaggtacacagacaaatggagggtgagcaagatgaagaggagctttaattagcaatagaacagcttagtctcctgcagggggtcagctccttcctgcaggcagggtgtcccaacaagtgttcagctcctagcagagaggagaccctggagtgggaagcttctctctgcaggcaggtcctcccatctctgcagcttccagcagaggggaggccctggagtggatagctcctctctgaagctggttgtcccgacatctgctcacttctggctgagcctggggatttttgggcctcagaagggagaaagtgcatgccaactggtccatcggtggccatgggtgggcccagaaaaggcaccacaagttcccactctggtccacaggactggcagcccagcccccagacttcaggccctccccggcctgaaggtggggcctcaccagggactcgccgccttctgcccaggaacctgtctgcctcctgctgtcattcacagagcccaggccataggtgccaagggatgcctacaggccagttatgagctgccctcaccaccccatcagcttccctactatgctcattggcgcccaaattccgtaggggtccaagccagcaggggactgacatgtcagcactgccctgagtgtgtgcacacccagccaggctgtggcagcacctgggcttggcccaactttgctctgagtctggagtggttgctgatagcagggagaagccaggagtaggagcaggcatttctgaccctgccagggtggtgggggccttcctgggcccccaagagggcaggtatgccagaatctgcagtgatggtttgggcggttgcagctgtgcccaggggaggggggcggggcttctgcctgctccatgcagcaggatgcctgggtctgcagcgatggtttgggtggctgcagctgcacccaggggagtgaggctcctgtctgctccatgaagcgggaggcctgtatccaaagctgcgacttgggtagctgcagctgcacccaggggagtgaggctcctgtctgctccatgaagcgggaggcctgtatccaaagctgcgacttgggtggctgtggctgcacccggggagctcccaccccaccaactcggaaggggcagggctcccacttgtccctgcctcatgctggttccaaggagtgtgcagccctggctgcacctccctgttgtagttcatatgatggtagcatccactccagactggccactgctgccttcagtgagacatactgggaaaccttccatattgctttgtgacttataacaatataccatggcattggaatagatattttcttggcaaatgtaagaaattatcaataagattgatggggccataaaataaaaggaaaagtctgctaattctagcctttttatccattttcatctgttgttctataaaaattgaaacatatacatataactggatttgcttcgctttttcaaggttgtaggagaaattacaacttaaacaaaagacctgctcactgagtctttctttccacaacttttatgagcatctcctctttggaaggctctgggttagtagtggagttactagaataagccagagaaacccctacccttagagtagtagagtctaggagttgcattcatgtaattaaggtggcgagatgtcctctaagatgcagaggaaaagtaagagaggggtgagggtgtggggctccaggtgagagtggtgaagttaaatgccctgagctgggcgttttgatctttgggaaaccgcagttccttcttgaggagttgattataatgaagctgacaagcgccacaatctcagaccatgagtcttagagggttagagaaaagcctggaatgaaaaactgctctgagaagttccttttgggtggtggatgtagcagagaggagtctccaccaggggcaggaatggaaggtgtcctgcacttttgtcccagcgtagtcgaacacagtgtaagaggtggctgactgatacccaacatctgccatctgcaagaatttcctgagataagcatgaatctctcaggaagggaggccagaagccactggccaggtactcttctgcctggtttggtgtacagctgactccactgaaatggctatacttttggtggggatgatatgaatgaggtgaatgaaaaatagtggtttggttgaaacagaagctgggagggaagaaaggagtttgtgacccaaattctaggatcttaaagttagtgagttgcactcagctatggaagactccccaacacctaattaaataatgaatcctcttcaagggacatttactaagcagcattttttagtgataattctgtttcccattcaactgcaaattctctgagatgtcctggaaaacaaaaatattttccaaaatctggggtcaaaataatgttagaaataaatgatagttgggctgggcacggtggctcacacctgtaatcccagcactttgggaggctgaggtgggtggatcacctgaggtcaggagttcgagaccagcctcaacatggagaaaccctgtctctactaaaaatacaaaattagccaggcgtggtggtgcatgcctgtaatcccagctactcgggaggctgaggcaggagaattgcttgaacctgggaggcggaggttgcggtgagccgagatcatgccattgcactccagcctgggcaacaagagtgaaactccgtctcaaaaaaaaaaaagaaataaatgatagttattaaagatgcaatgtatgtcaggcactgtgccaagtgttttaataaatgtcttatattctaatagtctattataaaaagtaccaaacacatgttacagataaagaaactgaggctcactgggcttagtaatttcccaggatcacatagttagtaagtgacagattggcaccagatccctggcctgattgatctagagaccacgctattcccattctccccagcttgaggtctatcttctgacttgtaattcatttttgtagtaagtattgcagaatgtctctaaggtgacaaaaagaagaatgctgaggtcaaggcactaaaagctgacctaaagtaagcatgtgaaaatgatcatctgaaaactgtgccttgctcccagtggaatggcccagaatcacctgccttccccctgacatagagcatgcctgcttcctgaaaacgtcctttggctgtcacattgctcaccctggaactcctctaatggcaacagcctctttgacataaaagttcacttggacagtgatgttcagatgcctggttatatgcctgagagtcaaaatacactctgaaacttttccaaatgggtgcaggctctgatttggcacacaacgtattccttcttgttactgaaatgtaaagttagataaagggtttttgaaagcatctagatataggagtaggattttaataaaatgtcttattagactttccactgaatacacacaggttaataagcttacctaggtggtcaaacatcaaagcttgtagatgcagaaagaccatgtaaaccactgtaggaaaaaaaaatctactgaagcagaatttctaaaaaccctggagccctccaaggaggtgaaaaacgcttcttctttggacatgctagctctgatttaaaaagaaaaaaaaaaactatatttctgctatctcttgtctgtgtgcctctccacaggaaaatccttgtttgcaaagtgcctaatggcacttgcacaagtcttcaggtaagttcagttatgtggacagtaacaaagactcacaagttaaaattttgaccatgaatcaaatagggtaaaaatctcaacctactgagattagaggttattgcaaagggaagtgcagaaatgtgccattgagtgaagaaggtgaaccttccctgatgagatttctagaattatttgaaaagtagatgtgatcctgtatttgaagcatctgtcatataataagtaggtacttgaaaaagctggggaattttgaagcaaatctgaccttttcagaaattcctcccagaaatgaagaggattgctgtagtaataaattataatacagttgacctttgaacaacatgggtttgaactatgtgggttcacttatacacagactttttaaataaatatattggaaatttttttggagtttgcaacaatttgaaaaaactcacaaactgcatagcctagagatataaaaaaagagttatgtcatgaatgaataaaatatatgtggatactaggatattttgttatttagtactataaaatatatgaagtctattgtaaaaggttttatcaaaatttatgtacacaaaaagttacagaccgtacatggtattattcacagtcaagataaatgtaaacaaatgttgagatgtagtattaaatcataactgcataaaattaactgtagcataagctgtgctactgtaataatttcatagccacctcctgttgctattgcagtaagctcaagtgttcttctatctgcttgaaaagccatgggacgctaattatctccatgtgaggagtttgtctctccagtaaattgcgtatagcagtaaaaagtgatctctcatggttctcacgtattttccatcatgtttagtccaatactttaaaacttgaataacaccattggatctatacaatgtgccactagtgatgctggaattcctgccaagaagcagagaaaagaaataacattataagaaaagttgaattgcttaacatgtaccgtagattggatttgcagctgtagttgcccactgtttcaagattaatgaaatctgcataagaaccattgtaaaaacaaaagaaaaaagaaaaagaaaaagaaattcatgaagctgtttctgcaactacatcagcaggtgtgaaaaccttgcacattttgtgaaacacctttttatcccatatggcaaatgcagcctttatgtggtgcagaattgccacaagaaaggcatacctatagattctaatatgaatccagaaaaatccaagttattatatgataacttaacgcaaaagatccgtgtagaatataaagctggagaatataatgccagcaaaggatggttcaataattttattatgtatatacatatatatttaaatatatacataataaaatgaaatatatatatgtatacacattatatataaactgggccaactgaggccagatattggggagtatgggcaagtttgggcaaagcacaggtatatatatatatatatatatatatatatatatatatatccatatatatatacccactgggatagaggcagtggtttgataatcttagaaagagatttggcttgaaaaatgtcaagataacaggaaaagcagcttctactaaccaagaggtagcagacaagttcccagacgtcattaagaaaattattgagaagaaaacatatctgcctgtacaggtttttaatgcagatgaaaataccctactccgggggaaaaatgccacaaaggacattaattagtgaggaagagaaggaagcaccaggatttaaggcacaaagcaataggctaactctattgttttatgcaaatgcagtcaagtttgtgatcaggactgtccttatctataaagctgctaaccctcaaaccttgaaagggaaagataaaatatcagcttctagtctttgggttgtacaacaagaaagcctggacaattagaacacttattctggattggttctatcgatgctttgtccctggagacaggaggtaccttggcagtaagtgactgccttttaaagttcttttgctattagacaatgtccctggccacccagaacccaatgagttcaacattgagggtgctgaaatgatcgaagttatccccaaacacaaggtctctaattcagcctctaaatcaggataaggacttctaaggctcactacacatggtactctatggaaaggattgtcaacgctatggaagagaaaccccatagagagaaaattatgaaagtctggaaggattttaccattgaaggtgccattattgttatagaaaatctgtgaaagccatcaaactttaaacaataaatttctgctggagaaaattatgtccagatgttgtgcatgacttcacaggatttacgacagagacaaataaggaaacaatgaaagaggttgtggatatggtccaaaagatggaatgtaaaagatttcaagatatgaatcttgaaaaaattcaagagctaatagacaccatgccagaggaaataacagaaggtgacttgatggagatgagtgtttccaaaccagtgacagatcatgaggaaaaagatgtataagaaacggtgccaggaaaaaaaactaacactagacaatctggcagaagggttccaattttttaagactgcttttgactccttttacgacatggacccttctatgatgtgggcactgaaactaaaacaaacagtggaagaaggattggtaccatatagaaacttttagatataagaaaaagaaaattacaacgtattttcattcaattacactgagtatgcctgcctctcctgcttcccctcctacctcttcctcctctgccagccctgagacagcaagactaacccctcctcttccttttcctcagcctactcaatgtgaagatgataatgacgcatatcttcatgatgatttacttccacttaatgaatagtaaatatattttctcctccttatgattttcttaattttttttatagtttattgttagaatacagcatattatacacataatacacaaaaatatctgttaatcaactgtttacatcatcaataaggcttccagtcgacaatagcttattagttaagttttgggggaggcaaaagttataggtggatttttgactgcatggagggtcagtgcccctaactcccatgttgttcaaggattaattgtagttgctttatgttggacatctgcaaaacagtttatgggagatactacaagtgctcatctatgtcttgtcctcctttccttcctgaacacaggggaacatcacagtccttttgaagttaggaagggtcatgtgattactctttgccactgaaatagaagcagacacattattttgtcacagtcatttctattgaaggtgctgcagaagcaatacattaattctcaaaccataacaacacagaacacagatcactctacacctaggagttgtcatacacatttgctcctttagatgtgagaaaccagattctgtgcatttaaggccctgggtaggaatcaccccataggatgctgactacaggaagtttttcatgtgacctgcaaccttcaggcttccgaaagtggtgttgtcctcctcagtatgggtggaaggcagtggccaaaatagccaaaatctcagttgagaccaggggtttccttctctcgttgctgtgcccaaatttgcccatagtccccaatacttggcctcagttggccctgtttacagctttaccgttcttatctctactaacaaccactgggcccaagacaggatctgatgattatgttaacacgcaaatatcatcatttgaaattccccagtaaggaatccccttccaagatattgtggtagaactggcaggagatgatgaagtttttggcgagtctcctagtggttggtaaataataatcattgcagtgtgatgagtgacaaattactatgattaggaggtactattcaaataatcccccatgtaatgcctggcttttgattaactgattaccttaaatgggcgacaatgaggttttgctttctgaggttgatccagagaggtggggctggggtgtcctagcagaggcagctagggcctcagtatgcccagagaggcagttaaagaagactaaaggctgtagcagatggtgggggcggtgaacatcgcaacactcctcagttcccagaatacacttagacccacattaggatttcgaaaggagcttggtgtgagagggctttggggtccatgctgaggaacagccaccccaggagatgagtgaggaggagcacctgccaaatccagctgtactgccctgggctggctgtggggagagggacatgggagcagaatgaggctggaccatgttatgagccaggtactcctgggaatggccagacgcagatgcctgtgtggcactccagaatggaaggaaggacactgctggaaacagggatactgcatgtcccttcttagagccaaggtgtgtggagagtgctcaccctgtgtttcctaaggactgcagggctggagcagctaggatgttccacacacccccacagcctcccctggaggcatttacagggtccagcatcctccacagcagcctctagtgtgggcacacatcacacaggacagagccaatcttgaccatgtcagggcggagcagataggagcctccctgtgcccatccgtggataggtcttgagggtttccagatgtcctgagcctgccccctgaggggcgggtgggaggcctcacagacatggtctcacttccctgggaaacctccctgttccaccagccatggctaaccccctactctgaactccagcccccttggcaaggagctgacctcctgcctggctcttgccagcccttccctttgttgacatcaacacaataaattgctggattttaattgggattttgttaaatatatagatcaagttaggaaaaactgacatcttgacaatactgaatcttcctatccatgtatatttgttttaaatgcctccatttattgtttttaatgtttctgtaccaatatttgtcttagagtctacatgggcattgattggtacatttcttcctctcctgaaaatctgttgttgtgggtagttcatctcacatctcggaactgtgcagatatggtataacttgttctagccctggctggggcaaaagtcagggtcactgaactggggccaggatcaatatatggatctgtgggtgttgaccctgaagaaggcttccaagacatcttccaggcccaccctccttgcattcaacccaacaccccaaagctttgtgagggagagtcctctggctggacaccctgaatgccaaagaaaaggttccacactgcattctcctggcctcccaagttcatggttttgaggaatgctggagccacattccaaattacctctgtcacagcttgtacttgcaggttggccctccacatgattatttaaaaaacattcttactaattgtctaggaaatgcaaatttaaaccacaatgagacaccaccttactcctgcaagaatggccataatttaaaaataaaaaaaaatagatgttggcatgaatgtggtaaaaagggaacacttttacactgctggtgggaatgtaaactagtacaactacagaaaacagtatggagattccttaaagaactaaaagtataactaccatttgatccaacaaacccactactgggtatctacccagaggaaaagaagtcattatatgaaaaagacacatgcacacgcatgtttataacagcacaatacacagttgcaaaaatatggatccaacctaaatgtccgccaaccaacaagtgaataaagaaaatgtggtagatatacaccatgaaatactactcagccataaagcagaatgaaataatggcccttgcagcaacttggatggagctcgaggccgttattctaaatgaagtaacatgaatggaaaaccaaacatcgtatgttctcacttataagtgagatctaagctaagaggatgcaaaggcataagaatgatgtaatggactttgggcactcagggggaagggtgggcaggggtgagggatgaaagactacatattgggtacaacataccctgctcaggtgatgcaccaaaatctcagaaatcacctctaaagaatttatccatgtaatcaaaaaccaactatacccctaaaactattgatatttttaaaaaaactatcgttgctcacacaatcattttcaaggtttgaatcagcctgggtttacctacttgtcaactgcaaacctctcttgtgccaataatatttccaatttccttttctacatttcctcccagaaagcagccagaagaggaattatgtctctgaggacacacttatgcccccataatgaactggaagccacctccgagtggtttgggtaagactctgtgatggttaatactgagtgtcaacttgattgaattgaaggatgcaaagtattgatcctgggtgtgtctgtgaaggtgttgccaaaggagattaacatttgagtcagtgggctaggaaaggcagacccacccttaatctgggtgagaaccatctaatcagctaccagcatggctagaatataaaccaggcagaaaaacgtgaaaagactagactggcatagcctcccagcctacatctttctcttgtgctggatgcttcctgcccttgaacatcggtctccaagtgcttcagttttggagcttcaatggggtctccttgctcctcagcttgcagacagcctattgtgggaccctgtgattgtgtgagttaatacttaaactcatctttaaatatatatacatatatctatcctattagttctgtccctctagagaaccctgactcatacagactataaaagattagttcttctggctgcaccttttctatgcttgacccctagtgatctgccagtttcctcatctgaaaaacggggtgtattagtccattctcatgctgatatgaagaaataccggagactgggtaatttataaagaaaagaggtttaattgactcacagttctgcagggctggggaggcctcaggaaacttataatcatggcagaaggggaagcaaacatgtccttcttcacatggcagcagcaagaagaaaagctgagcaaaaagggaaaaggcctcttataaaaccatcagatcttgtgagaatttactcaatatcccaagaacagcatgacggtacctgcccccatgatccaattaactctcactaggtccctcccatgacaggtggggatatggggaactacaattcaagatgagatttgggtggggacacagccaaaccaaaacatagcacaacttcggagcattggtgtaagattgcgctagtttcctgggactgccataccgaagtgttataccacaaagtgtgcggtataaaacagtaccaattaattctctctcagttctggaggttcagtgcctaatatcaaggtgttggcagggttgtgctccctctgaaggctctaggcgaagatctttccttgcctattccagcttctggtagccccaggtgttccttggcttgtggcagcatcactccagtctctgccttcagtttcacatggctgtcttctctctgggtctgtgtttcattttctcttttcttacaaggacattagtcatattggattaagggctcactccaatgacctcattttaactttattacagctgcaaagtccctattaccagtgaggtcaccttcacaggtattggggattaggacttcagcatattgaagggtatattttggagggtacaattcaactcataacgacgattataagatggcccaaagtaggccttcttatgatgaataaaaaggagcaattactgctgaacatctaagatgcaccttctcctgtacatggtaatatttctgaaagagtacagatcttaagatgcataagtacattgattcatgcagggttttacccttgaaaatctgttattaaatagatggttcatctcacatcttagaactgtacaagcatggtataagttgttttataataagacacaaaaaacctcaacatgtcaatgatttgtaggaaagtgggagtgtgggtacccacataatgtctgcagctattagaaacttggaaagaaagggtcatttttcctgcagacacaagttgcctggtttgaggcaagggatgaggaagaactgcttttttgtttgtgccctgtgactgtccaacatcagcattcatttcatgaccattgcctgagcacctactgcatgccaggatccaagaatacaggggcatagtgggaagcatcatgggactccaaaactgactcctccaagcacagagagctgagagcacacgcacagctgcctgtaggcagagtggggtggtgggaagggaagggaggatggttgcagacaatattgttctccaaaatggtgcacctgcctccattcactgacttctgtgtttttacaactgttgtttactctgcctggaacctcatttcctctcttcctaccttacaatgttattttttcagctcagcggttccctcatccccaatgcttatcgtgcacaatgctgtgttttcattattcatatctgtgtgttcccagtgccttccacagtgcccggcacaaagcagacactctggaagacatatgtcagatgaatgcaactaaaggagtgaaggttacaggctacccaagatgaaaggatccattaggggaaggcaagatgaggaagagcacatttgattagttagggcagagggccccagaggaatgtgtcagaaatacagtgtggaaacagaaagggagaaagacaagcattgagtggagattcagggatgagagcaggttgggaacaaggagaaaaaggaatcatgtgggcagctggttggtgacctttggcaagcatgggcctttttgtctgccccgtgtgcttggccacacacacttgacctgggctttgcatacacagcacactggaggagtgtggcacagccgggaaggcttcctggaaaccctggcatcaggagaggtccagaggagaagcacagggataccgtggtggtttgctggcccaggcaaaggctccccattctgccttccaacaggaaatggcccctgcttcctttagcagaaagcttgctccatgagggatgataaaccacccactcccagggctaccctgggtgacaggaggtccactggggccttgggactgtcctccctccctcttctctctcagtaactgtaatttgcttacctgagggaagactccctgaggaggtggctccttctgggctctggaaggccataggggttgctgcaagtccaagcagaactacagctactacctctgtggtcccttcagttgcctccctgcaatctcctcctccagttctccaagcccctaaatctagccccgtatttaatcaaatccctgtctagactccagacccacccacctcccagggagatctcagatgtgtatccaagttaggctaaagttgcctgaaacaaagggttctgtcaggaagcaggagattgcattctgcaggtggactaattcccagcatcttcagcaattctctaattggtggcattcaaagtgtggactttagggaacctagggtgaggaattccaggctaagaaagccttgcaggctggcacctccatgtttcctggctaaagaacttgtcaatctgacctccgagaagctctttatagtcccataggccttgcacgggactggatcccagctggccctccctccactggagcaagggtgaaactggtgttgagttcaaatctactaattccacactctctccattctactgctgcagccagggaaggagccttggtggtgtgtggagggcggttccacggccattttcttcccctatgccaggtctccccagtccaagtgtctaaattcaccaggattctcttcaccagtgccttgctcttcagaggagaggcatcctatatcaccacattgaagccaatgtgaatattgaattggacaagccaccagcttatcagaagggtggtacaaatccaagttagtccttaaaaccatggtcagatatacactgattcttctggaacactgtaacctaagcccaccccaaagtcacaagaatatgctgtctggcttatttgggggtcatactttttcaatccagagccatttctttcctttgagtgaagaatgttgggagcccctagcaagatagccctggaattttttggcaagtcaaggaaaagataaagtcaaactctgctagtggagaagatgtgggtgtcatcttctccactagtcatacttagccttgatgtatcacctttcttctgagaatgtagaaacatttaataagtggtaattaagcttcccaacactcctggtgcctgcatatgacccagggtctttctttaatgtcaggatcacttgtgggtctgtctacacaggtcattgaggctttggacctccatctagggtgggacactgagtgagggctctgaagtgagcagcaggttgtcagtagggtcttttgcacttgctggagagaggaccagatggccatctggtttctggcttttttttccccatgagagcaccagtagcatacagggttgggcttccagaatcagtccaggtaatccacctcttgaagactggggatgtgaagccttgggaaagtccagttcttcctgtatttcctcacagacaggttcatatgttcctcttggcaatttaccttgtcagagcaaaagaacacactgacaagtaatttgtgcatcagtgccctgttgcctttgctagatagcttccagggcctggtcaactctggaagaactgctaaaattgaacttgtgggcctgcagagcagtggttcagctcccagactccctgggatctcattaaagtagcgtctgccctcaagattctggactctgaggagcctgcctggtctctatctatgaagctcttgaaagggcagtgatgcctgttattcaagtgtctgaactggcagaccatcttctcatgcctgcttggggcacggtcactggtaatgaagatggtgctgtccaatctgaccactggcaagcacctctttctaacagtatgggctgcaggttcagctagaccctgagtttcatctgtgctccttcacccttacttgctggctcgctcagggcctgttatacaagcttctctgcgccttaattcctcgtctgtatttgagtgttcattgagaacctcctctgggctacacattggactttacctagaggatgggaaaggaagatgggtgaaaaagtctgggacagggtcctggtgcttcagcagatgaaaacttgatttggattactcaaccttaaaatcagctcatataataatatccatttcccagtgggtgttgggaagcttaattaccacttatgatatgtttttacgttctcagaagaaaggtgatacatcaagactaagtatgactatcgcaattgtgattctctcaagctgcccttggggctaaacagtataaaattgtcatttgtgaaactctgctattgcaacaaaggatgactattatccataatgatagtagactaatgtttaaggcattgttgtgctcatgaaaacttaaatctgcccaaagtgaagatggtaaactaggtcacctgctatgagcttgtcctgctcttggattccaaaagcaaacaaaatccttgaggaggttgacacctgaaagagtaccagatagcaacagcattctttgtacacctagcatgtaccaggcagtgtgttatgcacacgatctcactgaatcttcctaacacgcttagaaaagaggtttttatcatttccattctgcggaggagaaaaactgagactcaaagatgttgacttgcccaaggaagatgaacctggtacttgtaagtagggcagcctggagtggaggcagaggtcaggtgtgaagtgaccacaaagtttagacaggatccaaggaggctctgaactgggttagaaaaatgaggatgatttccacgtctcctgcttgaatacccccctgcgtacgaataggcctgctgctaagggaaaaagggaacccaggaggggaaggcggttggcacgggaagtgactttggtgctaggtaacttgagtagggaatagccagcatatctggacacgctggcttgggaattggaagggaagttgggacccaaactttggagtcgttgacagatgtgacaggtgaagcctgggatgacatcgccaaaaatgcaacgtctcactcattgtcactactcccagggctcagtcgtcactggggaaaatctccagaaggtagcgcgggccaaggtgacaggtgtctgccaagatctgcccgccagactcccgggcggcgcgctccctccctgcaggccttcagcccgtcagcatccccttcctcggggccctgctcactcccagcctccatccccctgccatctcctccgccggtcgcgtgcggacacaaggatggggacctcccagcgaggagcgctctgggcggggctccggacgcatgcgcggccctcgtacggaagcccggaaggaggggcagggggcggtggctcaggtttctccgggcggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgaggtgaggcggcgtcgttggcgcccccgggagtccgcgctgcgggctcgggcgcgggctggtgttcggctccggggaggcacggcgggcgagatgctgcagcccgaggacccgggcgcctgcccgagcctccctgcgggtgcaagcggtccccaggcaaaacagtcggcctcggcgcccgcccgcttcctcctcccgtgcccggtgctttcagcccctgcccggccacggccggaagggcccggccgcgagccccgtcctgccccaagggaaccccattcttttctgcttgctgtccctcattggtgtcccaacttcttcgtctcggttccatcctcttctgcgccgctgcgggccctccattctccgcgtcagggccgtctcactcgacccaacacccctacccccaccccagctgtttcctccagttcctcgcagtccttggggttttccttgggtttatgcccatccctctcttgtttgcttctttgttgaacggatacctgaaacactgttgaatccttggagtcagtgtcggggtatggcaataccttatataatgcatttctgggtgagcctgatcattttccatactcattttctcatcagtcttcactacaagtttatttgcaggaagtagatattgctgtccttcttttccagatggggaacacccagtggacagtgtggagaaaacactggctaagcactcaagcgcctgtccttgcacttgcccgactgttttgtaactgttctttaccccaggctgtgagctccctgaagctgagaccatctcctgctcatctcagtgtccccagcgcctcccacccaccgtatctggcacatagtaggcacatataaaatgtttgtggaactaaactgagcccaaagacttggattggagacgaggccatatgtaactgggtgattctctgcccttctttggcccttctgtaaaatgaggagttggcctaactgatctcttaaatgcactactctccgaaaggagtatccgtttcccttatttgccagttgggaagacgtgctcagtaaatatttgtgtgctgtaacctatgctaggtgctttagatgctggcggtctcagcatggggtgaagaagggcttgtacacttaagatgccttacagtactgtgcagtgctgtactgcgggggggccaactctggggacctatgccttggctgcttgttgaggatgaaaggaagttttaggggagtatttgtatgttgagggtgcagtctccctagggatggtgacattttaacttgtgagtcattgtgactttgtatgtgctcttattccactttgagttcatgttctggttaggagtgccagtgtctctaacacggtgcagacattatcattgttggcttcgaaggcatagaggaggtaacagaactaactgcagtcccttcctctgctgcatcagggggttaagattggtctgcagggtagtagggttggtgctgtggctggacaagccctgtatgtcttctatttggagatggtgataagaaagttaagtaaaaactgaattgttttgtgcccttgggcaactcacttatctattgttttatctgtagaatgagtataatctctcagtggggtagggaggccaattaaggattgattacaaagtgccttacaaatagaaagctacagtgacttgtttgcaaggtgacagagaattcagaagcctcaagaaactgccttaagtgatcaaacaggctaacagagttgccaaagcaaaatagtgctgcactgatactacctttaaccgttttttcctttagcccttttccccccaaaaaaattagtatatgaaattacagtgaaatacctggtatctaagcagatttatagtaattctcaacatattcatcaatctcttaattctacctgcattaaaatgtatttctacctgaaaagtttaaaggtcttttatactgtgccattttcctgattcattgttgccagaggtagtgagttccttaattttacagatatttcaagaggacattggccaggtattattggtaaatcagatttgtttttttagctggtagtgtttcacctctcctgagcactcctagtttttgacagtgtgctttagtctccttccatgctgaggaaggccttctctataggagaaagaaaactgaggggtgtacacaggaagttaccttatgctggggactcaaaccttgatgctactgctttgctccctgcctctatttttgaaccaattcaacatctccctcctaccccaggaccttgtcacacactgttctctttaccaggaatgtttccctctcttttcctctcctccagacctagtgaactcctatttatcctcacttggcacttgctaagggaagcattcctgacttccctgaccagatttactgctccctgtttctacagttcctgtagtatttactactcctccatcatagtgcatatttgtacccttgtgtctgtctggatgcttatttgattaatacctgcctcccccactaaactttaagctccatggggtcaaggccgtgactgtgtcagtatcgtagcctgcatacttggaatagtacctggctcaataaatatttgtggagtaaataactgaataactctccagagcctataagataaatctagagctgctgctttcaatcactgctttcctggtggtctgtggcctggttctctttcttctcacactcttcccaccttcagagtgcagccattgctttggagagatgggagagaacatggcactaaggcagaatatggctatatttactttgaagagcatgtctttgtcatagaaatagtcactgtcatggtttggtgggtcccaaggcatgggtcatggctccagatcccctttccagccttttggatcttggtaagtctgaacccactgctgcgttggcaaggctctggaaactatagtgacagagaatgattcacaagtgtcaacactcagatgtacagggctgccagctgacccactctacctatttccatctggcactgaactggttgatcatgaacttcttttcataattgctttttagttatgcaggttaagacatgccgaaacagatgtaccggacccacaaacaagtccttccttgaatgcctgaggcttcctaacagtgaaagagccctgttcttagagtaggcaaactgattctgaggcattgtaggtggtagggatctggtagtaggtagcattaggtgggctcccggcactcaccatggagccttgaaattttctgctactttgggggagttgctggttcagagaaggcccttccaccctggtagccatgtggcactggaaggctgtgaaaactctgctgggccttcttagtcatctgttgtgagctcctgatgggagtgtggtgtatccctcaggtgtgctagactggaacaaaggctgagaagtgttgctctgggggttccaacttgtgggcatggggtactgatgagatcagtagtgtttggagacttctgtatgctccatcttcagaagacattctggagtccatataagttatcttgtctcttgtttgaagcaggaaaaaggaatgcgattgctggtaatatagttcactaaagtcagctacctggcctctaacagttatttgcaaagtatattataacattgattcctcaaacatctagattcctatctcgtgccaagtgatgtactaggtgctctaagtacaaaaataaaggaatatagtcctcctctcaatgcgtaagcctagtggaagaagcagaaatgaaagggaaataagaattcaatagagtatgaggcattacagtgaaagaaaccaaatgtcttagaagtacaaatggcagagctactaattctgtctcgagcaggcagggaagagtctatagtggaaatgacttttgagctagattttgaattgagctagtcttttgagccagacttttgagctagaattgtagggttgtcatcagaccagagagtaggaagggtaccttgtgaggaagagagagagagatcagattgttactgtgtctatgtagaaaaggaagacataagaaactccattttgatctgtactaagaaaaattgtttctgctttgagatgctgttaacctgtaactttagtcccaaccctgtgctcacagaaacctgtgctgtaatgaatcaaggtttaatggatttagggctgtgcaggatgtaccttgttaacaatatgtttgcaggcagtatgcttggtaaaagtcatcgccattctccattctcgattaaccagggacacagtgcactgcggaaggccgcagggacatctgcccaagaaagcctgggtattgtccaaggtttccccccactgagacagcctgagatatggccttgtgggaaaggaaagaccttaccaccccccagcccgacacccgtaaagtgtctgtgctgaggaggagtagtgaaagaggggggcctctttgcagttgagataagaggaaggcttctgtctcctgctcatccctgggaatggaatgtctctgtgtaaagctgaccattcccattcgttctattctgagataggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggctggcccctttcagtatctcagaagggacaaagtacacaaaggcatggggtcatgatagtgcctggtatgttcaggtagtgaagaggtccatgtggtatgagcactgcagatgatatgtgtcgtatgaattaaaaatacatagttactgcaaatagtttttacaggttattgtttttaagaaagcagtatctaatgcacgagtgtactgtcagtactgtcaatgaactacttaccactcaagtgactgcttatctgttgttctgtcctctcaagccacctacagtcagaaaatggtcttgattttactgatgttgctgttaataatagctgtgacttcttgagtacccaccacatgccaggcccaatgtaggggctttgcatccattatccatgatctttacaacaaccctgcaaaattaggtatcagccttattttaaagtcttgacagcttgtgacttccctgaagttgcataggcaggaagaatctaagtcaacattcgaatccacgtcagtctcatgaagcctgtgctctttcctgcgtgccatgccatagttctagttaagtgacaactcctttcctccatgacattgtagatccagtatgctaaggaaccctctatttacaaattgtaagtgattaaacaaaacaaacctgttagtggcgcttatacatccaaatgagtgttgttattcaaagaggttacttggggaaagagaatgtatacacctattccattgttcatactccttgttactcatctggaattccctttaaagtcagtttacatatcacataagaagatccatctcattgctttatgatcatctatcattttcaaccaaaatagttccacctagtttgatcacacatcttattcactaaccttggctctgactgactgtttgccatttccaaaatttgaatccaccctcagtgaaaatttagcaccatttgggatagtcagaagatcagactgcaggttctcaaggtgcttccaagaagaaagcttcaaagatgatttgagtaatgaagtaccattggaattactgcattgcctcccaaggggactggttaaaggagagaaatctcatttgaatgtataatttccagttttaaaagtatcattcctattacttgataattacacacacattgttcttagctgtgttctttgagggccaggatttggaggtgctgaattacgtgctgaatgagtggatgttgggtacaaatagacatctaccactgggaagtctttgttgtacaggagagaccgtggattgaaggagttttagatagtttcctaggactccagaagttaagctttttaatatggagcttgagttttctaatcattttgcctgatatgtcatgcctgtacaagatgactggaatttaagacaaaagcctcgaactctggagatagatgctttataagtggagactcatactttgtcagctccaacctaatagtgacaacaatgattgctaaatgagattattacctacaatgtggcagaacttttgtctttcataatactgctaaagctagaatgggtaaaatgtatcatttacacagtgctttcacatacccttgtcttaatgaatcagtatatgaggaatcagatgaggagacagacctgggggaaaataactcacccaagaccacaccgctgatgaatggcagttgaggaacttaaatgcagatcttcctactggcctgggctctgcttttatttggcttttgtgcttttttgtatctactggttaaatgctcttaaacattttttatcttaataaaaccagctaaagtctccactaaaagactttaaatttggttaataaggtgtaagaggggcagttcccttgatagtttgtgagtatgtcaggttgtcatttggagccattctgtcaagctttagactgggatgtgccatccaaagtttgtgtgtgtgtatgtgcttgtgcgtgtgtacgtgcatgcaggcatgtgttaatgcgcgtgtatgtgctccagtgaagccagcagcttccactggaaaaaaactgataggtctaaaaagagtccagctgcattcttatgatatgcagaaaacagatactagaacttttacattcagagtcatcattcctttgctaagtatattctctctctccctcccttcttccttttctccctccctattctcccaaccctgcaaagtggagagagggaatttgagcctgagcagaaagctccatgtaaatttcagagaggatactagctttggcccaggtagcactacttagtgattcatcgtatactaacactacagattcaaatgagagtggaataaatccattctaaaggtgtaactggaaaagtgaattttaagaagtagtgattaatgttaaaccagaacctcccatttctcccaggtttgtggagaattaagcagtctatttttatacttggaatctggtctgaatgtttcttgaaaagtaactcaaagtagtttaggctatgaccataagttatttttgtaaatacattttcttatcactgtattattgcatattattgtgtattcttttgcaaatcaggcttgatatttccttttggctatgcagtcaccttttagactttgcttgcaaatatattgatatagttaagatactattctttctttccccaactaggagtgtgtatgaattacatcttttgaacttactgattgtattactttgttttacttgatcaactttgtagtttaatttttttaaaaagctagctgttgggattactgatcagtttcatttttatatctatatttctacttttagttttattattttcatgttttggctttttccccaaatttcttagaaactcagtttactagttttcttttgcctcttttttttttctttgttttctacttttacttaaacattttaaatgaacacattttctcttgagttttgttttggcagctgcccaggtatttttatgtttcaattgtattttagtaactctactaaactgcttaacaaatcagtattgaaaatgatccattttttgtcagtgtttttatgaattgtataaaatgtcaacctctggtctctactgattacaatctaccttacacactcatatgtatcttctgtcactcttgttgagaaaatctgcagtggccccatattacctattaataaattccaaggactttaccttgatattcacattcccctaccatgttaccacagccaacttctggcttattccccccagtaccctttctcctgtctctgcagcaccctacccaccacgatttatagaaagtattctgtgtgttccagtctgctggaattggagaggggaggataaagaggggatgagcaatgggtacaataatacagttagatagaaataataaatctagtgtttggtagcacaagagggcaaatatagttaataatgtatatttgcaaataactaaaagagtggaattgaaatgtgcctaacacaagtaagtgatcagtgcttgaggtgatggatatcccagttactctgatttgatcattacacattgtatgcttgcatcacagtatcacgtgtaccccataaataggcacaactgttttgtatccataataaataaaaataatttttaaaaaattggaaaacatcttattccctttgtctggaattccttattcccaacttgttgcccagattccacttctcttcccatctctctcagggaaattaatcttccaagtcccctagtttaccatatgtagttacttgttgatacatcatctccctctgttcctattagtctgagcatcttgagcgaacgcattgttgctcctttttatgtatctcacacatttcaggcactcaaatatttttaacaattgtaaattagatgtgtgtttattgtgtattgctgccccatgatcctttttttctccctggaaaaactatatatatgtaaagcaagtatgttttcttgttctgctacgtaattatcttcatataagcttgctgttttttaaattttctcgttctgctacttaattctcttcatataaccttgctgttttttaaatctactcttgtgttcatttccgtattttccttaggaactttgtctgttttatctgtcatgatttaagagtagcatgaggaagcccacaattaaaatatttctgtgtatccttaaaaaagaaaaattgtaaaattatttccatattccatggtcatgttaggtttttgttatttaggttttccttattagtccttttagcattttaatactttcggctttgaaatctaatttatctaattttaaagatagtaaattgttgctcttgtcttcatccaggcgtgctaaacctctgtcatctgatttctgatagttggttcgacttttgactttggttccaagcgtaactcttgaatgtaacaggtttactttcttaatctaggaagcaacctttctttttacagagctgtggtaggcagaataatgacgcccccaagtatgtccacatcctaatccgtggaaccagggaatatgttctgttacatggcaaaggggaattaaggtagcagatggaattaagtttgctcatcagctgaccttaaaatagattattctggattctctggctgagcccaatgtaattacagggcccttaaatatagaagagggagacagaaaaggaggtcagagtgattcagtatgagaagaactgcattctccattgttgactttgaagatggaggaaggggccatgagctaaggaatgtggcagcctctagagctagaaaaggcaaagaaacattctctcctagagccttcagtagcatagtcctgctgacacctcaagtttagcccagcgagacccatattggactctgacctccagaattgtaagggttatgccttttaaaccactaggtttatgctttttaaaccactaggtttgtggcagttttgaatggcagcaataggaaattaataagagaacattcagctcatgtatatttttctaaccctagtatttgaatcatgaattatattttgtgggtccttttgtaagtttatcttgttttctatttttcatgtaatagacataaaattttaagtttcctttaaattatgtcaaaaaccacataaaataatcccttttccaacatttaaaacattttggtacttctcttttctttagttccactactctctttttttattaaataaggaaactgttttacagaggataatgaagttagcttacagcatttaccaccccccccaccaatttactttttatttatagtctgaaaatcctttaggataaaaattacctgtacatgttatctaatttacatatgaatcctgtgtcgtcattatcttagcatttgttaatgtttgaatccactaatttcttttttaaatagtctgttttcaagtccattgtttctggtaattatatttgtagccacaggctttagttgacaaattggttctgatttttttagattttggaatatttccctctgctttaagagagaaaacttctgcctctactaattgtgtactgtaattgtggtgataactccatttctattaacttgtgaatcaccttgacacaggctctcttcttgtccaaagtctaagggatgaagtcatttttatcttggtttctttaaatgttctttctttgtagcagcttataaaagcctgtttttgttttcgagtattaataatattagctaatgtgtattgagtacgctggttatcagactgtttcccacagaccttgggagtgggccttgagaccctttccaggtatctgcaaagtcaaaattataatactaagacattctttgccttggtcgacattggcactggtggtacaaaagtagtgcatcaaacagctggtgctggagcacaaatcaggacagtggcaccagctgcactagtcttctgtcactggattcttcaccaccacgtgctggacttgcagttaaaaaaaaaatgccagcttcacttacgaatgtccttgataaagcagaaaaatattaatctcatttaatcttgacccctgaatgcacatctagtttaatattccatgtgatgaaatgggaagaatgcataaaggcctgttgtatgctgaagtgcaatggttgactcaaggaaaaacgtgtgtgcctgagttacaagctgctgttttcatggagtatcatttttatttggaaggacaactgacagacaagactgtggttatttgtgttatggtgtttggcagacattttcttgaaaatgcaggaagccacaataaacatacgtgtgcatgtgtctttatagcagcatgatttatagtcctttgggtatatacccagtaatgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgattgacattctaactggcactattcacaatagcaaagatttggaaccaacccaaatgtccaacaatgatagactggatcaagaaaatgtggcacatatacaccatggaatactatacagccataaaaaatgatgagttcatgtcctttgtagggacatgggtgaaattggaaatcatcattctcagtaaactattgcaaggacaaaaaaccaaacaccacatgttctcactcatagatgggaattgaacaatgagaacacatggacacaggaaggggaacatcacactctggggactgttgtggggtgggggttggggggagggatagcattaggagatatacctaatgctaagtgacgagttaatgggtgcagcacaccagcatggcacatgtatacatatgtaactaacctgcacattgtgcacatgtaccctaaatcttaaagtataataataataaaaaaaagaaaaaaaaagacaaaaatactataataaaagatgcttctatcacacacacaaaaaaagaaagtgcaggaagcaaaacttcaaggaaaacaactcatggtattttttgtaaatggtaaaatttgatctttcatgggaaaaccagaatttttgaaaagttgtatctgctaccatgagcttgacaacctcccagtaattaaaatatttctgatgaagttggtgaagatagtaagtaatgtgattttttttgctattgtatatgaaatgtgtcaacatttgaaagatctttataactcagtaaaccaatattttccagtcgacctacattgcattatacaataatgctgggataaaagattcattgaaagtataagagagaccagtggatttcagtgtagcagagtacaaaaaggtcattgatacgatttcagattccacatcatagttaacctttaagaaactaccacttgttgagttttagtgtcctgttgaagaacgtctaccattatctgaaagagctattaaaatagttcttttctaactacagatctctgtgaggccagattttctttgtatacttgaaccaaaacaatgtattgcaacagaatgaatgtaaatatagatattagaatctaggtgtcttctatgatatcatacattaaaaattttgctaaactgtagaaacagtgtcgctactctcactaaatttgtgttggttttggaaatgtttttaaataatgttatgtatgttagtatgtaatgtgtttattattaccttcgaagagtagatattttttgaataacaactgtatcgtaaatattaaataccaatagggataacccatatcaaccagagctctttgggatcctcagtaagtgttagaactgaaaaggagttctttttaagagttaaacgtcaaaatttttgatactaaaaactttgagagccactgatttagtgctttatacaaagcacttgttatactcattatcttatattcgtagccaccttatgaggtacatattattgccctaactttatgggtaagaataccatgacacaatgatgctatgtatatttttttagcaacccctctgaatctcatgatcttcccagcgtagttttctctctgggaggcttgcttccaagtttaattttgtaggtccagtcttcttacaaccctcctcccttttttccaatcgaagtttcttatgttatttttcatagtacaaaaacagtacacgtaccttacagaaaactcagatatcataagcaaaagagtataaagactatccttaatcttcccgagtggagacctgttagctgctcagcagatatttatacagatgcttttctaaacatgttcatttatcagtgtaaagccggtatagtataatactcaattagaaggattttggagtcaaatggtttgactcccaactctgagctcttagacaagttatttaacatctgagctttctgttccttatctgtaactgcactgatctgtttttctgtgtctagagttttgccctttccagaatgtcaaataagtagcattgtacactatcttgtgttttccatctgaattattttacttatagtgcattttagattcatcaatgttgttgttgtcatccatagtttgttactttttactgctgattagtattccattgaacggatatatcaaaattcagttaaccattcaccagtttatggatgtgtgagttgttaccagtggcaattatgaataaagcttcttggaatatttgaatacaggcctttgtgtggacatacgttttcctttttcttgagtaaaatacctaggtgtgggattgctgggccatagaataagtatacacttaactgtataagaaacttccaaaatgttttctaaagtggctgtactattttgcattcccaccagcatatataagagatctagtgtgtgtgtaatcttatctcattgtcattttagtttgcattgtcctaacatctgaaaatactgagtattttttgtgtgcttatttgctttttgtatgccttctttgatgggatgtctctgaattttttggccattttaaatcgggttgttcacttatttttttagttgtaaaagtcctttttatatactggatacaggttactttgtcagatacgtgttttcagagtatggtctcccagtttgtggcttggctgtcattttgttaatgataggtatcttttggagagtaagagtttttcattttggagaagtccaatttcatatcccatctaagaaatgtttgcctaaccgtaggttgcaagtatttttttttcatatgtgttttggacattttatagttttgtgtatgacatttaggtctatgatccatgtcacataaatttttgtatatgttataaggttaagagtcaaggtgtactttcctcatttatccagttgtaccaccatttattgaaacataattatttctccattgagttgttttggcacctttgtggaaaattaactgactctatatgtatgggtctgttttccaactctctagtacgttctatatatctattcttatgccagtactacattgtgtttattactgtagctttatagtaagctttgaaagcatgtagtataaattgtccaactttgttctttttcagaattgttttgcccattctaggtcctttgcactgtcatatgacttttaaagtcagtatgtcaatttctacagaagaacctgctggctcccaattttcgctgggattgcattgattctttaaaataatttggttaatttggtgtgtgtggtaggctaaatcatgacccacaaagatacccacttccatggaacctgttaaagatcttgagatgatggggttatccaagtggggcaataaatgcaatcaatcacaggttcccttaaaagagggagataatattaagaggagaaggcagtgtggtggaaacagagacagagatttgaagattttatgcagctggttttgatgatagagaaaggggccatgagccaagggaatacagctctggaaactggaaaaaaacaagtaatagattctcccatagagtctccagaaggagtaggtcctgctgacatcttggttttagcccagtgaaaccctttttggacctctggcctcaggataataaatgtgtgccattttaagtcaccaattttgtggtagtttgttacagcacccataggaaactaatacacagaggatgtaaatcttaacagtattgagtgttctatgaacacagtatatgtctccatttatttagatctttaatttttcttggcagttatgaactgaatgtgtccctttaaaaatcacaagttgactctagtccccagtgtgatggtatttggaggtggggcatttgggaggtgattaggttatgagggtggaaccctcatggttggaactagtgcccttataaaaagagaccagagagctaactcactctcttttcaccatgtgaagggtattgagaagtctgccatctgccacccagaaggcagccctcgccagaacccagccatgctggcatcctgatctccaacttccagcctctggaactgtgaggaataaatttctgttgtttattagcttccccacagtcctaccagtgttttgtaggtttcagtatataggttttgcatatatgttgttacatttatccctaagtgttttatatttgtgatgctattgtaaatggtggattttttcataaacttttaatttttgaatagttataaatttataggaaagttgcagtaaatgatacatatttttaaatttctgtttccaatttgtgatagctactatatagaaatgcaataatttttgtaaatttaccttgtgtccttcaattttgttaaattcacttactagatctactagcttttttttagattacttaggatttcctacagggaatatcatgttgcctatagataatgacaggtttacttctttcttttaaaactatattcttttaatttctttttatcatcttattgttgtggctaggacctttagtacaatgttgaatagatgtgttgaagtggacatacttgctgtgtttcctgtcttaaggggaaagtattgagtctctcaccattaagcattataactgcaggtttttcatagatgctcttcttttcctaatttgtttaacgcttttaacttgaatgggtagcaaattacgtcaaatgctttttacacaactattgagatgatcatatgatttttctttttcagcctgctaataccacgaaggttgctaactgattttcaaatgttaatccaagattgcaatcttgcaatcctagctaaaccacacctagtcgtaatgtagtatccttatatattgctgaattcagttggctaaaatcttttcaggatttttgcatctctgttcatgagagatattggtctgtagttttctttctttgtcagttttgttatcagggtaatgctggcttcataaaataaattgggaaatgttcccccctcatcttttttgcaagagtttgtgaagaattggtggtatttcctcattaaatgtttggtagattttgccatggcctgacattttctttctgaaaaaggttttaactagaattgcagtttccatgtctttgtttcaagaaatttcctggcataaagttgtttataatatcccctacttatccctttagtattattaggatttgtagtgatatccctgttttcattcttgatattagtaatttgagcctactcttttttactgattattctggctgtagatttaccaattttcttactttctcaaagaaactgcttttagtttcattgatttttttctctaatccctttttactgtattttattgattaatgtgcttacatttatcattttcttctttccatttactttttaaaaatttccttccgtttcttacatggaggttccttacctccatgttctttctagtttcataagatagaatcttagattattgacttgatatcttttctaatgtaagtatttgatgctaaaatttcccttaagtactgctttagtgtatctcacaaattttggtatattgtgtttttgcctttagtccaaaatatttttcaattttcttcatagtctttgacctatggattatttcgcagtgtggcatttaattttcaagtattttgagaattttccagatatttttctattgttgatttctagtttgactccattgtgcttgtttactttgtatgatttcagtccttttaaatttgttgagctttgttttatggcccagaattcaatctatcttggtgaatgttccgtgtgtgtttgaaaggaatctgtattttgcttttgttgggaggaactcattaatattaattaggtcaagttggttgatagtgttgctacaatcatatatatccttagtaattttctgtttatgtgttctattagttactaagaaaggaatgttaatttccatttataacagtttgatttttttatttctccttttagattgatcagtactttctacatgtattgtgaaactttgttattaggcatatgacaaattgacccctttatcattatgaactacctctatttgtccctggaaatagtccttgttcaaaaatatactgtgtcttatgttgtggtaggcagaatgccccacccccacaaatacacagatacccaggccctaagccctgaaacctgtgaatatgttattattttacatggcaaaggggactttgaagctatatttattagcattcgtttctgctgttaccatgacaaattactctcagttctttaggtcagaagtccgggtacagcacaactcagatgggtcttctgcctagtttcacagggtcaaaatcaaagtgtcaggagggctctattcctttctggagcctccagggattaatctgctttcaagcacatttgggctattgtcagaatttagttccttggggttgtagggctgaggtcccatttaccttgctggctgtcagctgcgagttattctcagcttctgaagcctgcctgcattccttggctcatggttccttacctccatgttcaaagccagaagtaacaggctgaatccttctcaagtctggaatctctctgacttctgcctcatctctcttccaccacatttctctgacttactcttctgctttcttaagggcttatgggattacactgggcacacctggataatccagtataatcttcctattgtaaagttagctgattagtaaccttaattccatctgcaaagtcccttcacagtattactcagattagtgtttgattgaataatcaggggacaggaatcctgggaaacttctttagaattctgcctaccaaccacagttatggaccttaaaatagggagagtagcctggcttaaccaggtggactcagtttcatcacatgaactcttaaaagcggagaactttctctcagtggaagcagaagcgatatggcagaagtagtgagaaaacatcccaagcatgagaaagattgaatatgctatagcttgttactggctttgagatgtaggggcctatttacaaggacccaggagaggcccctactatcgcaagatcagctgctgcgtgacagcaagcaaagagacacatacctcagtcctacaaccacaagaaactggattctgccaacaacctgaatgagcttagaagtagattctgccagagtcccctgataagcattccaccaacagacatctttatttcagccttgtgagattctgagtagagaaaccaaccaagcccgtctcgccttttgtcatatagaactgtgagataataaatttacgttgttttaagctgctaagtttgtggtaatttgttacagcagcaatggaagactaaacagatattaatatagtcattccagctttcttttggttagtgtttatttggtataactttttctttccttttgcttttaatctatctgtgtctttatagatagataaagtgggattcttacagacagcatatagttgtcttgcttacttatccaatctgatcatctttgtctttcagttggccatttatatttaatatagttattgacagggttgagttttaactgttttcttgctgcagcctggaaactgcctctgatctgcaaactggggcaatagtagggtttacctcctttatttcctccttctcacctgttctccactgcctgttgtcaatgtctgaaaactgttcttttgtagactgtatcaagcttcttatttaggcgggaaggtaaattatattcctattattaagtcaaggctggaaatagaggtcctcaagagtataatttctaattatttcaaggacatcctctgtagcaattcccttttatatgagacgtgagcatgtgtgtatgtgtaatttattcattcatggaaagtataatacatacactaaaatgttcatgccatatgaatatgacagatggctgcctttttagaaatagaatcagttagtgatagaacttgaccattttcagagcatgtcagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggagacttattttagtcttctttatgtttcttttattcccaacacattatgtctgccccatagaccttttcaataaatgattattgagttagtgactccttttacatgctgacaaatgtggctcttattactccccatttcagtatcacatatttgtaaaagtgaatccttcttaatcgttttacttttctcctagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccccttgtcccaccctcctagtcccagagctttaggactattagcagtgtaggggaggtggcttgaccaggagaccatgagtccctgagacagcagctggggaatgaggaaagtcaaagattggatgccgagaaggaaagcagagcctttgggggcaggggagaggggtaccctttaccgtttccaactcttgccctccctgctcttggatgcctccgctggcccaaattcctgggagttggctcacgccagcatgcaacctgcttgttgctgggacctgcgagaggctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaaactaccgcaccttttttttttttttttttttttttttgagacagagtttcgctcttgttgcccaggctggagtgcaatggtgtgatctcggcccactgcagcctccacatcccgggttcaagtgattctcctgcctcggcctcctgagtagctgggattacaggcacctgccaccatgcccagctaattttttgtatttttagtagagatagggtttcaccatgccaggctagttttgaactcctgacatcaggtgatccacccgccttggcctcctgaagtgctgggattacaggtgtgagccaccacgtccggccactacatcaactttttaaatttttgtttactaaatatgaaaatgattcagattgtgtaaattacatatcacatacatgtctaagaactgtaaaacagttacacagagagccttggcaggtgagggacattcatgtatagctgtttcagagttcttagattttttttgaaagattgatgacctgtgtggctgtatgtgttttatttttttatgagatattttcagatatctaatattaattgcttctcaaagaatgcaaagttaaataaacatttaggttctactaattgatatttagaatatattcaaacttctctttgttggtcttatttaagatgttttgagcaaggaaaggaattgtgtatgtggggttgaatgtaaggaatgtacaggcgtggtcattctcatgttaacattaaccagtggaacatggttgggtcctacaggaataacctctgatagcattttctctatgatctaacttccggtgtatttgtcacccacaatacatgtatatcataaatgttcatctgtattttgaataaacattgtaggcctttcagatgcattatagagccttttcctgattagcggccttaccattgctcaattgtagatctgttaaggttattgtgcatgatacttagctaattaaactgattttgtttgagaacagttttaactcttgttcttctttctctttcatctgcaggtgttaatttatcttaatggaatagaaaggaaaatgaaaatcatttatacgttttatttgcatttaaaaatagcacctaacaatagttactactatcttgaaatataactggcacttgttcatagaactagagttatttttataatattgtgtgaagggtggtttacatggtttcttgaaaaatgaggatcatgagacttaaggggtatttgcctggttttagcagcagaagcaaatcagcttgaataatcttggaagtaactcttgttgttgaatttaaagatgtgaacagaagtgtttatgtacattgtcagggaaataagaactggctattacttttgagaatatccttatacggttaaaacattaaattctggtttggttgtaatgttcattttgtattatgtagtagttcttcgatgtttcagagattgcctaccaaagcttaggtttaagttagctttctacctgatttccctttgcttttgtcaaattttcaagtaaaattcaaagtataaatataagttggtatttgccctgaactgcttgcttatagtggagattctgaactgagggtgttttcttcttctctcccttttttagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggtgagatttcatatatttaagaatgttttccactttgggaggtcaaggcaggtggatcacttgaggtcaggagtttgagaccagcctggccaacatggtgaaaccccgtctctactaataatacaaaaattagccgggtgtggtggcatgcgccagtaatcccagcttctccggaggctgaggcgggagaatctcttgaacccaggaggcggaggttgcagtgagccaagattgaaccattgcactccagcctgggtgacagaatgaaactccgtcttaaaaaaaaaaaaaaagaatgttttcaaaagtaaaatattttgctcagttattcagatgtcaatttcttaccctttgttaggaagagcttgatcattaccaactctacatcatgagacaacaaggcaacaaaagatgatggaaataacaatttttctttcttcacttagaacactagcttttcacccaggacatcagccttctcccagcttcacatcctgtatcaatcagacagaaacagaactgataggttagatacagatatatgtataaagagagttaaggaactggctcacattactgtggggctggcaagtctgaaatctccagggcaggtgaacaggctggagacctaggaggagttgacactgcagtcctggcacagaattttttcctctccaggaaaccacagtttttgcttttaaggccttcacctgattgcatgaggcccacccatgctatggagggtagtctcctttattcaaagtcagtaccttcactgcaacagcaagcttagtgtttgattaaataactgggtactatagcccagccaagttgacactcaaaactgaccatctccccacctcagaccccatgatttagcacctcccctgctgtctggttagcttatcctgatgtgcccctgtgtttgtttattcattcaataaacatttatcaagtatttactagatgccaagccctttttccctaagcatagaggatatgcagatgaataaaataccaggactagtaataatagtaatgaaagtaattgcagataacgtttattgagcacttactgtgtgccaggcattgtgcgaggcacattacatgtggtagttttcttactaactaactctgtgaggtaggtccagagaagataagtcatttgttcatggccacatgtgaaggggcaggaccaggattccgtttgagtcagcccgactctaaagcccgggcacataactacataactgcatagaagctgagggcccaaagctgaatactgatgggttgaggggagaactagaggctgtagatgcctggttttgagccgtgtggatgaagagtgaagggagaagactgcagttggcttaggaagtaaacatagcagctgtagggtgggtcaggcatataagcctagaccccaggtatgggcgtgaggggaaggtatgtagacagagggacggtgatggagcaaggccctgtgggactcagggagaatgggacctagagcaccaggaagggtttggccttgaacaaggggagctattccctgattttcatgctggtggaaaggccacagcatgggtatagtggtaggtaggagtgagccgtggagggagagtatctgatggtccactttcaccctccctacaattcccagtttatatcagggacttgagcatccatggattttggtatccacagggggtcctggaaccaatcccccacagatactgagggacaactatacaaggactaggactgcattgggcctgaattacagaaagtaagtctttcatatattcacactctaggcattcctgcccttggaagaaacaacataccaggagctgagctccctcctcctgtgatgcaagaacagtacctatgttggtgagggggtggtctggagtaggctcatacagagatgggaaggaggagttgagggtctgccaggaagccctgtgttgggagggaagggatggcatttttgggacacattgaagcctagaggcaggaaacactccatcagctgagtggactgtggcgattcagatccgacgggagcacaaggtggaaaggaaggaactgtgggagttgagaagagagggagcctctacagagggattggggcaaataggggccacgtcctcagcccacagagcatgtgctgaagtgccccaggcaccccagtgcactcacagggcaccaggggatagtggacattttgaggaaaacagtaatacctgacatttgttgggacaccatacaaactactagcttgaaatagtttacaggtttatttttaggccacactgcattcctttcagtgacgtcgtatctttaagaagctgggttttcagcagttgctgtgaaaacaaaaaaggctaatgctgtgtgaaaatccgggtgaagaacaggtaacgagtgggagcaccttgtctgattccaaggcgtgggaaatggtgagctacctgacaggcacacgcatcccactgggaattagttttggttatttaagaataatattaacatttttctttagatttatatgaattattttttctggtggctacttagaaatacttactaagttagacgtaattacttaaatcagtgcaactgttggcattcccagccacattagggatttcttttggcctagaggtctatggaggaattactaaattccccatgtacctatgtactgagaacttttgggaagctctgggcctggtcccagatttcaattttgtgggcaagaatgtactttaccagagtgaggagcagcctgcagggcgtttgggctggaggcgggaggttagtaaggggttgctgaagtggtaggcggatggtgccgaagaaggcctcactaggcagtcatcatcaggataggaagtgggcacgggattcaggagaaatctggactttacagtggacaggatgtggtgactgaacgtgacagtgtgggaaaaagaatgcagggtgattcccgggctcatggcttgagaaatgagaccactgttgtgcctccaagtgacatgggaggctatagaaagtgacatgggaggctatagaaagtgacatgggaggccatagaaagtgacatgggaggccatagaaagtgacatgggaggccatagaaagtgacaagggaggccatagaaagtgacatgggaggccatagtgacatgggaggccatagaaagtgacatgggaggctatagaaagtgacatgggaggctatagaaagtgacatgggaggccatagaaagtgacatgggaggccatagaaagtgacatgggaggccatagaaagtgacatgggaggccatagaaagtgacatgggaggctatagaaagaggagatacaaggttctaagtgcaggcgataatgatctctatttgggactggcttcatttgaggtgcctttaggagagccgagtggcctatgcacagctgggtctgctatgcagcaggaaggctaagttggagacagatgtgagaactaaccatgaaggaggtaataatgcagaccaagggtctggttgaaatttcttctcccccagtccagggtgcagcgggtgagtgaaaatatgtgtgtttgtgtgtctgtcttcctagtcgggagagaagactgagtttgtggctctgcggagcatcaccatttaaggagggggaaaaggagacagaaggaattaccagaacactccagagggctccaagactgtatggtgggatcctagatggccaggaggaggggagcaaaaaggaaagagtcatccacagtatcagtaggatgccagttgaagtgtttttgctgcctcccggttatcggtgactttgatgaaagctgtcttctggtggtcatgggggtggaggccagatcacaaggaagctgggaatggtagatgagatagtaggggcttgcatattcattactgtctcgcagagagaaacctgaggctaagaggggtcttggatcaaaggatggggtgggtttatctggtttcggggcttttgtttttaatgagaaggagtcatttctgtgctgctaggagggatcaatggaataggtggggttaaagatacagtacggaatctacagttgatggcttgatgtgacaaggtcctcaaggagcctgaaaggaaggggtggggtccaagggcaaaaccgaggtatgagaagaaggatgcacaaggatggtttcgagtagacagtattgttggtagggacatgaaggaagcttagtggtctattgcagctagcctgtgttcccagtgaacctggaaacaaggttctcatctgtgctcaggcctcaggccagaaagggcaaggcagcagaggggcaaggcagcagaggggcaaggcagcaggctgagccccatttccccttgccataatactgctgtgcccctctggtaccgaaaatcaggagtttccagtgcaatataatattatacaagttacactgtattataatgtgtattgtcttttagtgtgttaaccaaattactgcagtattaaatgcaaattatactttgtttaactgattcttctcttcatttttagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaacatgacttctaaagtttaattgatacaaaatattcttcaagtgcatgtatcagaccatcctcttatttctaaaatatggtatttccattgttgccagtgttgaatgattttaaatcatactgcagtatatatgtttatgcattaaaatttttgccttttgttttttggttgttttcttaggaaatagtccagaaatagtgttactgagctagaggttgggaactatttgagattcctatatacgtatactgcactgccaacttgcttttccaaaagccatacctggccaggcgcagtggcttacacttacagtcccagcactttgggaggccgaggtgagctgatcacttgagctcaggagttcgagaccaacctgtgcaatgtagcaagaccctgtctcaaaagaaaaaaaaaaaaagccatacccatttacactcttgctggtggtggcatctatgtcatgcttctaaactgtgacttcagttactgggcatttggttgaaattaactgtgaataaatgggtagatggatgcagagatagaaagataagtggcaaggtagaaattagagaacacagtatagattccactattaaatgcatggaaaaaagatggagactaaaggcagaagagttccattgccactgggaggtaaggtcatgctagtgtttttgttcggttttattttctctgttgtttgatgtataattttgcatacaatatattttatgtattaaatatagctacccttaaaaagtgaaaagtatagtaaagaattgggagcagagaagaaatgaagggaacctaagtatactccatatttaaagatgggaataatcacttctgcccaaagtctttgataaaacattcataataaaaaatattcagtcactcatcctacaacttcacagtgctgtatctggagaatggtcattgggttcaaaactgtttctgttgtgacgtgaaggaaacatatctaaacaagaccaaattttttcgtataagatactgtcagggaaaaaaaagattagtaattttgagagctttccacaaatgagaagaaagattttttctgcccttcatcctctgtagatcccagttgatgaagcagtctgagtacatgtttcccatagtgagcaagagaaaacaaggaagcctattgagatctaacattccacccatgaagggaacttcagtaaaaaggagaatctcatcacagaatggggaacggggaagaaaggctgtgcatagactctgcagagaaacctacaatcaagaactggtcaggagaagtaaaattcgtatgccaactcaaatcatagatctaaaagaaaatgtaaaactatagatctgttaggaaataacataggacagaatctttggggtttgcaattaggcagagagtacttagaaatggcactgttaatatggtccatacgagagagaaatcataaatttggacttcctcaaaattaaaatgaaatgaagacaggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggagaattctagaatgggagctgttgactccttagaacaaacacccggaggagtttgccataaaactgctggcactgggaacttttcaagtggataggctattgccgagctctgaagagggacataaaagctcatttcgagctttccccagggataggtggtttcctgcctttttctggcggtgctgatgttccctcttgtgggagctcacgcgggggtggggtggtggggaggaactgcctaatgaagtctggcttccgcctctgcccattttcggtgctggcatcaaccgggactatgtctctttctttagattctgctggttcacaaactggatggccacaacgccttctccagcatcccgatctttgtccccctttggctctcgttgatcacgctgatggcaaccacatttggacagaagggaggaaaccactgtatgtactcagcatttcagaagtccttggtgtgtgtctggggggggaccagggagtgggggggggggcggatagaagtctaggaagggatgagtccccgagggccccaatttagaagcttgtgtgggaaagtgagggctgaggaaattctgggaccttctaagggaagggcatgccgtaactctggtgttctgctggcctgcaccgggacttttctcgcagtgcacgctgccatttgaggtagaaccagacacggcaggcaacctctcagagatcccgttccctcctctgcaaaatggggatcaagacagattcttcccaggcccgggagggtttgatggaaaatccacatctcccacccaaacctgggattcatcctaggtccctgttggcctctctgcctcccccatatccttgctgccatcacccgagtcttgcctgtcttgccttgctaacactctattcccctccacctgcttgctgaggcagacacttccaaaacgatctctgcagagggtgccttcctggcaaggctgtgggctccatggcacggaagcccagagcattgcccttcggaaagccagtgggtttgggggcagggcctcactgcagcccagcagcccgggctgtgcttgctgtttgtgcctctgccccctaccccgcacccgggagcagggagggcttgcaccgagctgacactccagtagcctacagagaggagtagtgggactgggaaagtggctttaaggtggctccatgagttcaggccccctcctggccaggacccgtgcatgactaccgccctcacggattccagagggtgacagaaatcttgttcttgggtggcactgtcatccatgagtttatcctggctggagaagattagcggaagacaccgtagtctgcgcaccacagatattttgagactcactggagcagtagttctcaaacttgggcatccagcagaatcccaaaagggccaggaaaaggggaccgctggagcccaccctagcccgactcagtttctggaggtctgggctggggcccgagaatggcatccctaactaggccccgtggacgctgtccctgccggtccgggaaccccactccaagcaccacagagctagcatttgcacttcttccccattttgggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattttacacgtg

SEQ ID NO: 1042 - DNA, 35276 bp, mus musculus; identical to SEQ ID NO: 1023

SEQ ID NO: 1043 - DNA, 3634 bp, mus musculus; identical to SEQ ID NO: 170

SEQ ID NO: 1044 - DNA, 15586 bp, mus musculus; identical to SEQ ID NO: 171

SEQ ID NO: 1045 - DNA, 19121 bp, mus musculus; identical to SEQ ID NO: 172

SEQ ID NO: 1046 - DNA, 14394 bp, mus musculus; identical to SEQ ID NO: 173

SEQ ID NO: 1047 - DNA, 3762 bp, mus musculus
caatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggtaagaggcacgctgttccctggcatcttggcttgaggccttggactgcccctttcttcccggctcccacccaggcctcgactgttggaaggagctgagccaagtgttcagggagggggcgctcggtctgctctcacccctcgcacctggacagattgagctctgctgggggcccgcccggaagaaacgtagctcgagaaggccgtagaagagaacggggtgcggggccgggacgaggggcgaggggcgaggggcggcgggtggcagggcagggcggcctgagggacctccgggctgccgccggttttcgtccccctgctggttggaaaaggggaggtggtgaggagctctcgactcagcatggatgctggagacacagtacaatgaataggcagaacagccagtgctaagatgtgaaaaccgggaatatcactttgtctgttgaaggaatgcagtggtctcgggaatgttgcctcgggaaatggaagaagagaccgatgggaaaataggatgataggttgggagtgtaaagtccttctgtgtcttgctaaggaattgaggttttccagtaggcaacgggctgtcatcagaaggcctttcgttttaactacatcattctaacaacttagtggagaatgaattgttgagagaggaggctgaaccctcctgatggcgctaggtcccaggttcgctagtgtcctagaggggatcgggttgctccacaggccgttctggagggcgctgcctgtgctgggtggctttttaaaaattttattttatttatttaatttagaaatagtagttgaaaactatttgactaatgagagaaaacatctgactggccctccaggccaggtcatctgtctgtccccacttagctactataaaatcttcatggaagtttctcaatcttttggtttgtaccttaccttacctctgccttttttttactaactacgtcttatatccttctaaagactcatttatttataccacacttgatattgtatattcgcatttgctgattgaatttcgtaattggttattattttgtgtttttatgagctgtgtcatttatttctctacattgatctattatctaaccataacaaggaataaaatttgttgagtgccaggcactttcttaatgattttacaaaattcgaggtggtagctactactgttatgcccgttttttagatgataaaactgaggtacggggcacttgagtaacttgccccaggccacacaggatgtaagtgaggtatccagggtttgaacttggacaatccgtggaggtccagactggcagcttacccctcatgctctgctactgggaggaggtgaggtagttctcatgaatcgccctacttctcctggtcatagcatagtgcctcacacatagtataagctcaaactaagtgtctaattgaatttccatagggccttaaatgttacattcatggtgctcagctagagatggcgtcagaaatctaactcgggaggagacactttatctgagggctttataatgtcttgaaatgctttttccctacaatgtcgtggttatttttttctagaccttaaaatttctaccaacataatgtaataagcaacccaaattttatataactgtttatgtttccaaactattaataattgaagtgacatggtattgtagaaagattattggcctctaaatagaccagggtctgaatcctggctctgcttcccagttgctgcttaaccttaagcatattattttaccactttgagcttgagtttctttaactgaaatagggatgacaatacttagagagttgttatgggaaacagagaacatgcttgcagtattgcagtgtagtaggtgtcgaataggtattaatattcatgatgataggaagcaatataccatagtggttagaagtcagacccagtccattccccaaccccgctgaggcagtaatttgttttctttctctgcttgaattgttgtttcacccttgtccatttcatgacctcttcatctttccacatctagttcagatatcatctccctgtagttttctctgacctctaccccaaaacaaaatccctggcactttgtgtccctgtggcacattatgctatacataggtgtcacgtactcttataagcgtttcacatatgctaactcatttaatccctggtgacgaaaaggtacttgtacagatgatgaggaaattgaggcaaagagaggttaaataacttccctaaggtcaactcatctaatgagtggcgaagctgggattcaaaccaggcacctcctgtctcttaaccacagcctatgccgctatagttaattcttgctaaactccagcacctgataacatgtatcatgtgccagaaacttacacttctttctcttccctgcagtgacccttctaggaagatggcatctctctttaacatacagaactcagccattatctctcagcctcaccttttcaatttcctttactgtctagtttgatggcttcttagttcactcccttgctgtgtttctcttcctttttcttccttgtttcagctaagatattctctggtagctagtaaatatggataagaataatgatgtgaagatcttagaagctataagataattgaagttacttataataaagaactagagttctgtaaagtactagacgactcttgtagcatctcttttaagtttcatatattttcatcttgtttctgatccttatctaattaactagcctttcttcaaggatcagcatgtggtataaaaaatattttaacatcagttttactgcttttcttttgatcagttattactgttacaaaagattattctgtttgccttttaggtttactttgtttcagttatttgatactgaaggaagcatttgtggattgccttgggaacccagtaaccatatttagtatgatttctatggtaaaacttgttgaattaaaaataagtaataaaattgataatcttgacatgcaacctgtaaaatcattttgtgaataggatgcatgaataggcaatgtatttgattgttagtttcatatttactactagggatgcatgggaaatgcataaagtggtgggcaaggtcattcttcttttcctatttttgaataaaaaatgaagaggaaagtgaaagaataaattagctatataatatatatgtaccatctgaaattgtctctaactttttataactacaggttgagcatcctaaatctgaaaatctgaaatccagaatgctctaaaatccaaaactttttgaacaccaatatagtgctcaaaggaaatgctcattggagcattttggactttggatttttggattgaggatgctcaactggtataatgtaaatattccaaaatctaaaaaaaaaaaaaaaatctaaaatccaaaacaattctggtcccaagcattttagataagggtgcttaacctgtacttttagttaaaaacaaacctttggagaaaaacaaagcttttttttcttctatgttttaaaaacaaagcagtcaaaaaatctgagtggcatgaattctaaaatttgtaaagtattatttttgatattaaagga

SEQ ID NO: 1048 - DNA, 286 bp, mus musculus
atggccgacgaaaaacccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcagtgaggcagatcagattccgattcgacgggcaaccaatcaatgaaacagacacacctgcacagttggaaatggaggatgaagatacaattgatgtgttccaacagcagacgggaggtgtctact

SEQ ID NO: 1049 - DNA, 286 bp, mus musculus; identical to SEQ ID NO: 1048

SEQ ID NO: 1050 - DNA, 32613 bp, mus musculus; identical to SEQ ID NO: 174

SEQ ID NO: 1051 - DNA, 37095 bp, mus musculus; identical to SEQ ID NO: 175

SEQ ID NO: 1052 - DNA, 3979 bp, mus musculus; identical to SEQ ID NO: 176

SEQ ID NO: 1053 - DNA, 61541 bp, mus musculus; identical to SEQ ID NO: 177

SEQ ID NO: 1054 - DNA, 61541 bp, mus musculus; identical to SEQ ID NO: 177

SEQ ID NO: 1055 - DNA, 15 bp, mus musculus
gccacgcccccagcg

SEQ ID NO: 1056 - DNA, 3911 bp, mus musculus
gggatttaaagggcccgctcgccgcgccgctctgggagccgctgctggtcccggccttgcggcctgcgggggaggctgcccggaggaggcagcggcggcggcagcgcgtcctcggtccccaggaccacggcttctttcctgccaggtaggtcgccagtagtgcgcacgcggctccccagctcccatccctgggccggcctccccaggcggatctgtagcgcgagtgctaggaccccctccccatcacctttccgactctccctcaggctatgtctcctaccaccacctccttgcagcccccggacctgggcaggactttgttggcggcctctcgccgggtggggatgagatggggggcgcggaggatacaggacaccccccctccccgtgccgccgcatccatacaaggagagatgcacacggcccccaagtgtcacagaatccccctctctgccctccactcagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcggtaagtgcctgccataccgtgtgccaccatgccaggccatatcagacctcccacattcatccatatcgagccacaccttaccctgtcacatcctgccaggccctagcatgtccaagctggaccccaacatgttcagccccaccacatcccaccaggccaaaccccattccaccataccacatcctactatgccagccaccccatgccatgccacaccgagccacatcctgccatgccaagccatgcccttcagtattcctgagttctgggattccagaaagctgagattcttggatcttgggattctgaaatgtctacatcccaaggttataagacattggcatgctgatgtcacagggttatggaatcccaaagtaccatgattacagcgtttggagattctgacaatttgaaattctcacattctagacttctaaaatgttggcattgtggatttctataatcagggcatgatgcgatttctggattctaggattctgaaatgtttccacagtcatagcaggcctgtatcttaatgaaagattccaagtccccaagattcctataggaggcggagatttctggaaatctgagatccgaaggttctacactttcttttttctttctttcttttttaattttaaatggatgttctattttttcccaggtttattattttgaaatttttcaaagctactgaaatgttgaaaaaatagtacagtgagcacccacgtatgcatcaccagattctctgtcaacatcttgccacgttagctggctctatctgtctatctatctatctatctgtatatctatccatctatctatctatctatctatccatctatctatctatcatcttcctgaattgcctgaataacctgctgacatcatgacactgtaccccacatccttcagtgtgtggcccctgagaacaaggacatcatctcccacaaccacatcctccaccatcaccccacaagacattgaatctggatacaataatgttatcctatataaattgatatttgaatttcttccaaggtcccccaaatgccctttatagatgtttcttttctttaaacccaggccctgccaccctctccagctccccaacacctgctttgggcccctccaatcccactacattccagcctgaaggcctttgccctggctacgccctctacccaggtcatcctccccttcctactagcccaccaaccttctctttcttgttctccctctctctctccctccctccctcccttcctcccactccctctctttctctctctttctcgttctctctctccctttctttctccctttcacccaaagggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatggggtatgagtatgcatccttatcctcacactgttggctgaagtgcatgggtgggtccccaggccccatatgaagttgtccaagacagggagggtggtgagattccccggagaaagaagggagtctgggagaatcatttgcctatgaggagacacagaacaggtaggacgtggagtgtccctggagaagggaatctgggagatttgtcctttcacaggactgtaagggacaggttgggcatgggctccccctggaggagggagcctgggagaatttttccaccatgagactgttgtaggacaggaggaggtagaaccctctgggcaccttggacccccttcccctgtcccccatggtctcagaggccatgagtgtcatgggaccaagaccagcacctttttcctcagtgagatgcacatggtagacaccgtgacatggcacaagatgcgaggtaggtagccctgcccctctcacctgcccaacccccctgccccactcctcgtctcctaactgcccccaccctgtgcctttcctctcctgcttttctccctcacctgcccaccccactggacgtgcagacctcacattactcttgggtccgtgtctctttccaccgtgcattttcccgaagtctgtctgtctcgtgtcatgtatgtgcctgactctctggagtaagggcatctatctgtcctgggcttccttgcccacctgcctatctgtcccatgcccacctatccatccttgtgcccgcttttcctaccacatctcacctggtgcacctcctccttgccatgctgatctgctctctgcccatccacttgaccatgggcaccacacataggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactggtgaggtcctgagtggatgggtgggcagggactgtgggagccaccctggggcagcactcatggagtgcttgatccctacagagctgccggtggctgcagaaggtggcccggagcctggcactggccctgctgtgccttgtgctgtccacttgcgtgggcccctacctcttcccgtacttcatccccctcaacggtgaccgcctccttcgcaagtgagcacagccttcgaggcccctgcccagcaatgagggggttgggtagggacccgcggtttccccagttctgagcctgtctcttaatgcttctttctgtcttctgttactacagcaagaaacgcaaagccaggtaaatgagggcaggtg

SEQ ID NO: 1057 - DNA, 3911 bp, mus musculus; identical to SEQ ID NO: 1056

SEQ ID NO: 1058 - DNA, 30230 bp, mus musculus
cgggcgcgggcgctggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccggaaacccgccagcttggacatctggcactgcgagtccacgctcagcagcggtgagggcctggcgcgccgcgacccctgcctcccgccccggactgccccgcgccccactgccaggacagtcaccgcctgtccccacgtccccgcatcctctgccctggcccgtcccaccccgtccaggcccttctcggatcctggggctcccgccacctccctggcatccacccctcttccctccccatccctggtcgccaaacctaaagcgacagcccacgccctctcccttccccgtggccattcctcctgttctggagtaacacgtacgctattttgggtatttgttatcatttgaggcgagagccatgtggctgtgtaaaaaaatgcgacgccttccacacccccgttaaaaaagaagcaggcaaaaacgccccaactccaccgagatgctgcgggggttcgctgttcggtcttccccactctttttccttcctctctcgaggacgaatttgcctagtgttcacatttctgccggttccactccaccttatctgcgttttcaccaatgtatttcggtttggattttatttccttacgtttttgatggatatgaagagttgagagagggacaggcttgttttcctttccttttttggtgacgccgccgttgattgtgagttgcctttctttctctgccactctaagtaactcttctctcctccagacctttcttttctccatgagctactcacagatgcctagaaagttgtgctttattccgccagcgctgaaagctgcaaatggataagatgggggtggggagtggagaataaggtagctactgaggctaccagtcccagggggctttactgctttccgccctccctgaccctccagttgccttccccggcgccccagttatgcccttagcaaaaatcagtcaacttatgatttctcgctacaaaccccttcctttctaattttgattcttcaactgctggtgtcagcgaagagaaagggaaataaagagagaggacctgccggcgattttctttctttctctctctttctctctctctctctcacacacacatacacagactcacacacacacacatagacacctgagaaactcattacattccttccagtttcatgtcttctctgggactatttataaagctttcctggaaacgtttcaagttgtaacaaagttgaaatagcacaaaaagccacaaaaatctgattttcttttgtctttggtttcctgttataacacaggaaaatttgaccaagtttcttctgtaaatttaattttgtgtttaaaaaaggctttttctttgatactacctcaaaattcccattgaagggtttcctctttgttggttaattcactgtggagggaactggttggcagcaggaggtcaacatttaggtccttcaattctttcagggttggcagtttacaactaaagataaaataaatcggcagaatttctttcttcggtaaccaggggatccaaataaactttggcgaaaatatctcctttcccctcttcaataataaaatttatgtaggaatgacagctactgcacgactccttggcaacgtgaatgttttgcccctttctctctgtctcctgaaataatagacccctgattgcataaagacttttcagataggttagagaaaccagtttcaactcacatttgcttttcaagccagtacccttttttcttggccaggaatgtagggaatggggagaagccagctcgagtttgcagagcaacatacagtgtttgctaaccttttcttaattgcctccatacccatttatctcagcttttttcctctctagtcaaggaaatatggagacgcaagcctaatgcaaatatagcggtaatagcactctgcaaagtaaaaatcaaaggcaggcccagtttgggatttttccctgtttattctacccccttgctgaaagtcatagcccagcgtatatttctatttggatttctgaaaatcagctttcatcttatcttgccttaaaaaaatagttttcagcccagataaagtagaattcataagcaaatgggtaaaaagtagagatgattttgttagaggttttctggaacaagttcttgactttgtgtatatataatagcagttcattttttgctctccacggtgatggtgggacacagggcgggggtggaggaaaggaaacaagatatggaaaattgctctgtgtccccactttacaaaatgtactttcttatgttatgtgaatttgaagcttctgtccgccagtgttttgaaaggaaggggaatgcccgaatcaaaaccagcagtgcttttcttgtctgttccaaagggcaagcagcttttttcgtctgtttgctgtgtggagtagcagaaaacagggagggaaatgtcttctctgaagattttgagagatccacatctttgtctttcaaaataaattaccttgggaggaaccaccaaggacacttttactgaaggcccttcaccaggatctttaaggcttaattaaaaatgtttgtcttaattagaattaaaactgctgtgaagaggcaggcctgtatttactgaaggagcatttcaggaatgtttctactcacaatagtatgccctacttagacccagtttctactgaaactttcccctaagccattatttttaaacttgcattttaattttggtaccaaatgtgcatcatttgctgtttataacctgttttatgattttaagcaaaagtagaaccatgcctcttgtgttctggtgtattgaaggttgcgtcagctcttctagtacgaaccactaatccggttgtcagtcagccgtaatgcttttctctggtgttccaattcaatgtatggaggacagttgaggcactcatcttaagttctaagtgttccagaaagacatatgagaaagcggctaattgactgtgattaatggtggaaagagaaaaaaaaaataaagtgtgcttgttaggaagtttagaatacgcagtactcacatggctgccggccacagaattctttctaagggtagttttccccagtactgttttggggaaccttttaataaaccttaaatcttacacaaattatagtaatattttagacttctgcttagtcacatttagtttgctaactttatttctaggatatagttgctaggatttcacagcaattacaagaatccttagtgtaaataggattggcacaagtgtatacagaatgctgatgccctaaatttgatatcaaatgtgctctataacctctaaggagactttacatttcttctttaaaatgtataaatacatagctatttcatgtaaagcagattgctttttggtgtctgtgtaatttgttgactaaggagaaagcaaggacatacagatggccaaatgaacacttttactaacagtaatttagggatataacaaattcatttttcctttttttatcccaaaatacttgatcaaatagtaccttttttcaagggatattgttaacatcattcacatactatcctaaaaatagctgcatttgtaacgtgagtcattggtagttttgaaatggcagtataccatatgctaataacaggtgaatattatcatttctaattgacaagaaattctttttagagtgctttatatgtagatctttttttaactttagtataaaaagctactttaaaaggaatttataagaaagcctatcttaggtgttaaagataaatggaactgcctaaccacctgcacgtcttagcaaatctgagatatagtgattctgagttcaaacatgtttcatctgttcatattttgcatttattccttaattcgaaaacacagtttcattaggaaacctcacaatgtgatttgctccggggaaggttcagcttgttgcttgaaatgtgttgatattgatgcatttttacaaatagctccgcaagcctggaagtcactattgttatacccacttctggcttccttgaaaagaacataagaagaataaatgcagttttgtttaacctagacatcatagacgggtggacagttaagagtaccagagagcaccaaaactttctccactgataagccagagaaaaccaagtataacttatttcaagatcttcctgatgactttctcttaatgtcttttagattttcaggttccttagatttacttttacaaaggacattttaatgtgtgaacagatataatttctcttttgctcacattcatagaaggattataattcccagggagccacttagatcagtcttggcagctaagggatttgatgggtgtgggaaaagcctggcctttcgtaaaacatttcaaaacaaaacaaaaacaaacaaaagaatatctcaagcaatagattttacttgctgtcgggaatacatttcaagaaatttcctgcaagtttttgtttaatagtaagaccacttgcagagaccatagatatagtcagtgctactagacatgctagtgaaaggaatatagatgcttcaaaatgtgtctctggaatacctaacctaaataccacagcagggagctctctgaaccacttctggttctgagggctaccccaaaataactaaccgaataaataaataaataccacaacaaacttccatgtgagctatgctaaattgtaatgtaattctgtatcagagtagagtagtatgttggagaataaatgagacattggattctaactgacctgaacttggccacttaccaatcatgtgacctcatacaacttaatgtcctcaaatggtttatcataaagattaaatatatgaaagtgcctgtttgttagtgttatgtttcttcctggttacgtattcagaaaatcccagtgatacttttttcaataattgaagatttttcccctttaagtagtaaaatctctgcattgcataatgaattgcataatgaagtactttgtcaatttcaaatttaaattttgatatgcattacctaacatttaacaatgctcttggtagatcatgatcacaaaactattatccttttattcagtcctattacaagccagacacctcagttattcccaatgtcacaataaacttgcaaggtagctaaagttatccctatatattattgaggaaactttggatttttgttaagattaccaaggtctcaattaactagtggtaaagatggattcttaccaagagtattccagttgctaatgctgggaaactaaccacaacaaaagttagtcgtgtaaaataaccattttattatactcatgaattctgtgggtcaggaattcagataggacataatgaggatggatgtctggagcccttgtggaagataacttgaatggctaggaaccagaacgtctggaactgtagggtcattttccaaatgatttcgctcacaggtttggcaccttggtggggaaggctgtgagatactgggcaaagctgtgactctccctggaatgcctacaggtggcctttctagcattgtggtcttaggatattggaattcttacaaattgagtgggtcccgcaggacaagagtcataagagccagaatctctctgaactaggctgagaaatcacacatgtcttctaccacattcagttggttacaaaggagccatatggccagcttggatttaagggaaggagaattgaataccaccttttgatggagcagtggcaagttcacattgtagaagagaatgtgggataggagttgctgttgggccgtgtttggagcacacagtctgacactgagtctaactgcaaatctgcattctttattgcctttgaagaacaacaacaacaacaacaaacggccaaccagtttgtctttgctttgtagcttctgtacttaagaactttgaattgattatataaataatgtctgactgggacaaaaccttccctcagccagcatatggctttaatgactggttacttgtactttggatatgagatggaatgaactcgagaacctaacttttccacaaacagagagatacatgtaaaaccttccaaaatctttggtttagtctcaaacaaccaaggctcaaactgattatgaatctggaatgtaatttgctactttatgttgtatgataaaattttattctttttttagaaagttatgaatgcatctgatgatacgcttgctacatgaacactaaaacattaaaattccagacaggagccaagttttatagtgctagagaagtgttggagttagagttattttttgtttgtttccttttcctttgttttaataacatagctcttctcttaactactgcccatgtattgaatctcagagttgtaacgtgtttaataaaatagacaagatttttaacataatccagtctaatcaaatttattacatgattaaggaaaatgaagaaggatacaatgttaaacactcaatagagagggtacattttgccatagtatttttggagggttggtttttaaaatgttctgtaatattgtagataactgtcacttggtgtttgaagtattgttgaatgatgtcatgtatggaagcttggatgaagaggtgaaggactgcatgtgaaatagctgcccactttttgtaagattatttatcatccatgatttgatttcacatagaattaaagtctgaaaatagaattatatgtgttgataagtacatttcagatgtttattaccatcaaatttacattttaaccatgactagtgcttaaaaataaacacttctactttaagtttctccatgatggggtacgttaaaataatggcttgggggccaggcgtggtggctcacgcctgtaatctcagcactttaggaggccgaggtgggtgaatcatgaggtcaggagttcgaggacagcctgaccaacatggtgaaaccctgtctctactaaaaatacaaaaaattggctggacgtggttgcgggctcctgtagtcccagctactcgggaggctgaggcaggagaatcgcttgaacccgggaggcagaggttgcagtgagccgagatcgtgccactgcactccagcctgggcagcagggcaagactccgtatcaaaataaatttgaaaaagcttaattttttttttaacttttattttaggttcggggtacatgtgcatgtttattatataggtaaactcatgtcaccggggtttcttctacagattatttcatcacacaggtattaagcctagtacccaatagttattatttttcctgatcctctccctcctcccaccctcaaccctcaagtagaccccagtgtctgttattcccttctttgtgttcacgagttctcatgatttagctcccacttataagtgagaacatgctgtatttggttttctgttcctgcgttagtgtgctaaggataatagcctccagctccttccatgttcccacaatatgcatgacctcggttttttttctggctgcatagtattccatggtgtatatgcgctacactttcttcatcccatctgtcatcgatggacatttaaattgattccaagtctgctattgtgagttgtgctgcaaagaacattctcctgcatgtgtctttatggtagaacaatttctgttcttttggtatatacctagtaatgggattgctgggttgaatggtagttctttttttaggtctttgagaaatcaccatactgtactgctttccacaatggttaaactaatatacactcccaataactgtgtataagtgttcccttttctccaaaaccttaccagcatctgttattttttgactttttaatagaagccattctgactggtgtgagatggtatctcattgtggttttgatttgaatttctctaatgatcagtgatattgagctttttatgcatatgcttgttggacacatgtatgtcttcttttgaaaagcgtctgttcatgtcatttgcccgttcttaatggggttgtttatttttctcttgtaaattcatttaagttctttatggatgctggctattagatctttgtcagatgaatagcttgcaaatattttgtctcattctgtaggttgtgtactctgttgatagtttcatttgctgtgcagaagctcttaactttaatttatccaatttttcaattattgattttgttgcaattgcttttggtgactttgttatgaaatctttgcccgttcctatgtccaggatggtattgcctaccttgtcttatagggttgacaacgtagtttatagtttatggttttgggttttacatttaaatctttaacccaccttgaattgattttgtatgtagtgtaagaaaggggtcaatcttctgtatatgcctaaccagttatcccagcatcatttgttgaacagggagtcttttctccattgcttgtttttctcaattttgtcaaagatcacatggttataagtgtgcagccttatttctgggctctctattctgttccattggtctatatgcctgtttttgtactactagtaccatgctcttttagttactgtagccctgttgtatagtttgaagtcaggtaatgtgatgcgaccaactttgttctttttgtttaggattgcctttgctattcgggctctttttttggttccatatgaatttgaaaataggttttctagttctgtgaagaatgccagataggaatagcattgaatctgtaaattcctttgggcagtatggccatgttaatgctattgattcttcctatccatgagcatggaatgttttcccatttgtttatgtcttctgtgctttctttgagcagtgttttataattatccctgtagatctttctcctccctggttggctgcattcctagatattttattttttttgtgtggcaattgcaaatgggattgccttcctgatttggctctcagcttggctaacaatagcttaattttaagttgaaaaagaatttccaaattttgtagaagtcaaccatgtatgtttcttaaattgattaaatgaatattaattttcattcaacaacttaattgcattctggctttattaaaagtatgtattaatttatccaaaaagattgaatgttctttcagcagaatttcaacctcacacattaaaggcactgacatttcaattttactaatcttttcaaactattggttcacctcccttgaaaattagacaaggacacctttccttaatgtttttactcctaagtttgtgtgtgatttgggtacacttgtagatcatcaattttctattctaatcatggacactgaagactctcacttaaaaaatgtacaacgaaacatccatggtcttccaaagaagtgagaaaaaatatctataacacctttgtctctatcagcttgttgactgttatgaggtttaaaatgatattttaatgagccatgtttcaagagatcacatatttatactttctgttcaaaatttctgtttattaggcaaaaccatgttaaaaaaatagaagtcgagacccctgaattacttattctctgtacataaaaagggacagacacaaaagaactaaaattttcatcaaagaagattttattgccatcatgtttaaggtccctaaaccaaatattcaccagaatgctgtcatgatgctctgtgaatgaagcctagaatctattcttagctcctctaggtaacttaaaggggggtacattcgaatgcttccctctattttcccatcttctcacatatactcaatgagttaacttcattgaaacgtagtcattggttttctagcagagggtagacattattctgatacaaagtcagccagttagtctgtgttccaggcatcgtggaaggtagtgagaataaaatgatgggtgaaacaaatggtgtcttttaaacaaattattaataattaaataaatgtgcaaagtgctgtgaaggagaaaacaaaggttctacttctgcagcggggcattaagaaggagctggtgggagtactagctttgccaattttattcctccatatttactaaaggggtatcttaatactatcgtgggtggctgtctggctttcttcattctactctttgattattcttagctcccctaaacccattacagtaactttagttgcttagaggaagtttcacccactcctaatcctggagtagtaggttttctttgtgcttttcaaaataatcaagttttccaagttgtaacctaattaggtttttattcaaagagtgaaaaaagaacaatgttcaaaataccaaagtcatcacaactttgtagaaataccatgattagaaattattattgaaaaataccagtacttgttaggtaacactagttaccatcaaatgcttatgaaaactttcaaagatggtgcatggtaagaaacagcagtcattaggggtgatagtgtctttctttttgtccaaatactggaacttgccttaacagcaaggctctttgctaaatactgtattcaagtggttttatttgaggaaaaaacaccatatgttattgtgtttagattattaattacatttccactgaattatctaagacagaattctgtgaagcagctaaaatgttccattatttgttgaaaataaaaagtatgtgtgtttttttttctaacatcaacataaaacaactccaagatcttgaatgaaattgacattgttaaacactagtaacccatctggcattttggacaaccgggattttccaaaatttggcaaaattaacacgcattttggtcgttagggttattgtatcatctgtttggatggttacctggagtcatttatgtctgtagtttaaaatcaggttagcactatactttggaggcagtctttatctgtgaacgggcctaaagggtagtattcgaaatcaaattgttgccaacctgattactactatggatatctaacatagttgctttggcaaacatctattttgctttgtttgtcacaacacacatagtatttatattgtaattttataaaatacaaataattacttgccttaaattggatggaaaggcagtatcctcatatacaaagaaatatttctttgcaagtgaaaaattatagttttgataccagttttaataaaagaagtggtcattttaattattgaaattagaatcagaattcatttggctgcctttctttgtgtctacatcacagagtggtggaaaattaatgcagtattgacaaatttaggtcagaatgcaacttagccaataaaccaagatttaagctgcctcagtaacgtttcagttttccacctcattagcacatgcagactaacttttaaaagttaagtagatcatttgatacctttagaagtagttaggctaagtttatggttctacacaaaatagcattccattctttgtgtatgaggatacaggcttcctatccaaactcagaaatgcgtagcattaatattaagataaattctttagttacatttcgtgaaaataattaaatgccataatttctgacaaagtgagctagttgggaaaaagacatagtctttggtgaatagatggataatttagggaatgtgagtttgaaatattcttctgtatctgagctttcttttttcctttagtactaaaccatcctactatttccggttcctgatgatagaatgggattggcaatactaacttaactatgttctcaacaatgtaatttaaatgttttgctataaatatgtcctacaaatgaatacaagtgtttagaaaagctgaatgtttgctgggaatgagtgaaaataatccagtctgtttgggtgaattaggaagaatttgtatataacttgtaattcaagatgataggtaaaaaaatcattgttctaagttgtctggtgaattattttattgcagttatagatatcattttagttaatataatttccttttggaggggttcaaaaatgaaaatacaagtgccagtctgacaaatgtgagtgtgatttaaaaatcagtgttttaatttgtgatgagaatgatagaaaagcgagaatcatccataaaaacaacggaatacattgaggggaatactacccacctaaacagtaggacttctgtttatgaggttaaaaacttgtttttccattgctttttaattatatctaattttctaaaggaaataggcattatgtgctcagggatttacatatagtagaaagaatctcagcatataaccagtagctacagaggtaaataaattagccagtgtttgacaagtgaaaggtttctaaatgaggtgagtggaggcagaaagctttaggaactggttttgtgcattgcccttggctcaaaaatatcgaaaatgtatccttgttaaaattttgtcttttctgaaaattggaagtgacttttgatcatgaattccctaagggaatgataattctccaattggacagttataatgtggtccatagaattttcataatgcagtggcgatttcaggccagtctcatatgttacaatgctaaaataagtcagcacaattctgcagaatactaaactgtttatagacattggaaactctgatgccagctaataaaaataccttgaaagaggacttgaaatcagttcctgagttgcatgttaatgttaaacttgatggtgtagtatagggactgcccgatttttatcttgtaactgcaaggggaatataacattatgtgtatgtattttcctggagtttttttttctttttactttttttttcctgttatagaaaacactagtagagaagcatacacttatcttgagcctccacttctttcggtgcagtttgaatgcccccagtgtgtcactgtgtcaattttgccaaaattcttttgagagaacctgacacgtaacatggcagcctgatttcaggtttggttttcagatccaaaacatgcctcccatcccattcgagccctcaccaatttatcaaccaaggatgtatgttatttcctcaaaactgattatcacctgttctctgtggtctcagaaaccaaactcaggtttccaatcagctggcgtgacattgaacaatggcccattttaattgtgcagagcactgcaatttgtaaaacagtaccatgttcattgatgttctgcaggtctggtttgtgtttactgttccactatagtattggtatattatttatagaaaggtagaaaactaatgcagagtaataaatctttacagactcttaactcatctgactaaatactgtgaaggctataattggacaactaaaattgatatagaaattaactgattgtgaaaacttaaaatgcatgacttttttgaagaaatggtgctggaaacagagaattttatgaaattttaatttgttttgcaaacactgagtgtaggttagcaggtatttgtggcatgcaaatcttttggtggaaaagtcagggtagaacaagttttctggtctcttataatattactataaaattgtccaagtcttatgtatatgttcttgctaaatctagtattggacttcggatggtaagtaaatatctgtctaactgtgtcaatgtaaagcccagcctattattttaatagccattagtaggtgtctataaaatatttttcacttttttttactccccatatcttagtcttgttcagtaagagagagggaaatggtaactggctgatttacatagtccttgattttagttcacctcttaggctggcactattatttggacaatggattctagttgtttactgaaagagatatgatgccacaggccctgtttgcagctccaaagtacccacactgaaccttgaaatgcacctcagacctccttgactatgatagccatatcgaaccactttttcagcttcctgatcgaggttaaactgatcagcaatttaaagttttggtgctgggcaactggcctgagtgaatcattccaaatggatataatgacaacaattctaaaacttggcaccattcgccagggatatagtctcaataatccagtctaagccccaggttttggccagaacagtggcagtcatggcccatttctagtttcttttggaaaataaaatagcttttctgtttgagcagtcatatctctggttgtggaccaaaggaaaggtagaaatatcacaacagtggtaatgctgatgattctccttgttgactttacatctagggtaactttgtcattagccacaacctcagtgctgaaaataaacataggacatttagaagaaaatccagaactgattatgtttatctactttttagaagtatttcctgtgctataggaggttctttttctaattaggttctagtcccttttacttttattctcctggtgctttctactatagcattttactggtttttcaaatgaaatgaagaattgctatattgaggaaatgtagcaatatgcgattaggaattttttggaattttctctcgctatattggttaagcatcactttgcactcctgtattattcatttattaaattaacttcattgtgtgttttgtagtttaaaagatctttgcctagaaaaaagttcaacatttgaaatgctaaataaagtataatggttagcaaacagcagctcagccatggagtccaaaccaactcaccacctgtttttgtagattaagttttattggggctgggtgcagtggctcacgcctgtaatcccagcactttgggaggccgaggcgggtggatcacttgaagtcaggagtttgagaccagcctggccaacatggtgaaacccagtctctactaaaaatacaaaaattaactgggcgtggtggcacatgcctgtaatccctgctactcgagaggctgaggcatgagaatcacttgaacccgggagacggaggttgcagtgagccaagatcgtgccactgcactccagcctggatgacagagtgagactctgtctcaaaaaaataaataaataagttttattggggcacagccagcttgtttacacattgtctgtggctgctttcacactatcatgcagagttgagtgggtacaacagagaccataaatcataaatccaaaaatatttctcgtctggccctttatatggaaagtttgcttatcattttctaccttagtctgtctttacaaaatgcaaaacgtgtattttagctatttttttgaggatatttaaaatagagaaaagtgatcaaaattcattcctgtttgaattatggctgaaagtgaagagtcaaatgtgtggcattttttttcacactgagctatgtgaaagagctaatcaggaaaaaacaatctattgcactttcactttaagatattttatatgggtagatatttagttacattttgatttaaatgaatccaatgctttaaagtttttacttatgtaaaataatttagggaaagttgctaacagtaataatcgttctataagagtaatagaccaactagaacatatggagcataggctttcttaatcaaactctccaggaattgcatagatggatggatggatggatggatggattttatttttttcattgtacacttttatataattaaactttgatttttttaattcagaaatttcaatttacacacctgtttttagaaggatttccatcatgccaaagtgcaatataattgtgcacttgtgtaaacttttcccaagaaatttagagacttcaaatgtaaggactatttttttttttttggctttttaattcaaagctacatgctgttatggaataaaaaagcccagtatggctagccttttaacttctagttaaaagccagatctacttttgtttgaagttgtatggctttgttacaaatagatggcattaagaagatgctctccactttgttgtgactcatctttatattttaagaagtttggatttgttcaatttccccttgtttgtttgtttcttgattgcagtgcaagttctagttgagagcctgtgaagcttccacaatttcgtaggaggggaagatgtggaagaggatgcttgagacagggatgtacaaatataaataaaagaaaatcttagggtattggcaattcctctgctcatcgtttatcctaccgtaacaaagagtgcattttggaagctttctggggggataatttcagagggaagcatcaaaatatcatgacttctggacttaggatagaatccattgcaatttaatgatagattaaaatccatttgcattttctgcacttacattaaactgagggccagaagaggcgcttggggcttttaaacaactgctgctctccatagtatcgttttatatgatgtttcccaacctgtatagtactttcatagattcactttgtctcttctgagagaatattttaccattcttatgaatggaaaatgggccagtttttcatcatactatttctacatttttgttttataagaaatgaatgcatttcaataaggtttatgtgtcactaagagtgtgagaaactgtttggaagtatctgtgaacagaggcctgcacatagtaagtggtcaatatatgcttactgtttccgtgtatgaatgaaggggccgagcagccattcagagtccattctggctccctgggaatacttaattttagaaaccacacccgtgatggtaaatacagcagtgaaactagaatcaaataaaaaagaagtggaaaaaacaaacaatattcctgatgctaatttgatggggagttgttttagagggagtggaggagagacaaataaaaactttggagatttttatatggttaaggaaggctttccaagaaatagcaataaaaaaaagaatatactactgtcacatgcagcatggatgaatatgagaaacttaaaagccagacacaaaatagttcataccatttatatgaagtttaacagaaggcagaactcaatctgtggtgacggatgtcctcagtagcccaggtgggagggtcattattgactgggaaggggcgcaagagaaaaatctgggtgatagaaatgccctgtattttaatctggatggtgtataaatatctataagaattcatcaacttctctactttctatacttaagatttgtgaactttattgctcgataaaaatttaaatcataataatattgaaaataggtcatggaggggacacttgatttaacatgaatgcctaatagagtccttggaagaaaatcctagcaaacccctggtctaaaactctgctgagcttagcataggagacttttctgaataaggacatttcctattcatttttgttgcaaaacatttcaaaccccaaaggatgcttagcatgcagtaaaatcacatctgttgagccactgcaaggtgaaggctgctgaacatagttctgttgattctttgaggacttactactcaaaaacaatttcttttttctttccagattggcagattgctactctggctttactcctgggcggcgctgccatcattctcattgcattcctggtgggtttgatttctatctgcgtgggatctcgaaggcgtttctatagacctgttgcggtcatgctttttgcagcaggtaaacagattcattactttcaaatgagtattaaagtttcatgaacctttctaccatcttcctttcctatgcagaagaggtatgtgtttgctgcattacgtaaaaattgagaggcatttactatatttttaaggtaacttggctaaaggtttatcagattatcagttttcagtgtgttaagcatttcacagagcacaatggcagcttctaaacctctgactaaagcatgaacaaataatactgcctgacagggctattaccttaggaattgcagcaggtgtatttactaacagtcttttacatccagttttttccccttttttactgctcccctggtgatcttaaggcagcattattttttctgataaggaactgaaaacaaattccaaaatgtttacccttaaagatgtatatctctttgaaaatgtgtgatgtatgactccaaccattagacaagtcaattatatgaagtcaattgtatgttaattaatttatcaaccatcattgtatgaagcacagcttggattaaaatatcaaccaatgaaatgaaaagacgggactgtttagaaaaggggcttgcagactaaaagcccaatacatgatttgatgtgagctttaattttcatttataaaaatacctttgaatatattgttctttttgactcaaactgcaatattctgtggtgccttcagtttgccctgtcagtcatatctgatttgaagactgcaaagtaagcttctgtgactatcaataatgaagacactgacaaaaccatctaggctgttagatggatttttaaaagctgtttcaagattggaatagatgaaatttctcaggatttaaagggtagttggagctaaaaatacaaaacagaagtgttctgctgccccctactgtttgtgttcattttcttatacccatgaaggctggtcagaattgggggtgtcataaaaatgaaggtccaaagggctgaaggaatccagaagtacatctaattcaaatctttaagtgacttgctcaagatcgcatagtagctactggcagacctgggcctgggaggcttctgaatcttaatctagtggttcattaaccactgacttcctcacttatttatgcaactatttcttagatgcctattacaggctaaacacagtattagacacctataaaactggccacagtatcaccacagatactcactaatagagtagaaagcacaatttcaaaaaatattttgaagtcttagtcccagttattcgggatgctgagatgggagaatcacttgagtctgggagcttgacgctgcagtgagccgacagcacaccattacactccagccttggcaacagagtaagactctatctcaaggaaaaaaaaataataaaagtacctttttctgccgagacatgtgcagtacataaaatcaaaacagacacattactactaccgcttggaaacatctctatccgagacttcacacttacttgatttagtaccgtgtgctatgcctggtactcatatacactcaataaatagtttttgaatgaatgatataaaaatgactaaggcatgtagctcataatctggtggggtaaaacaggcatgtaaacaaataagtaactgtaatgaagggttttttttaagcaatttctcttttggggtcttaggaagcagctagtttcacatgactacaaagctaagaccaaaagacctcaaaaaagtaataaatatcaaaaggatgttttttcatatatttatgtttttatttatttaataaatatgttgggcacttacactatacaagtagacagtcttggtgttataaaatatactctaagggtttttactgaaaactgataattaagtctcataaagatagccaaacagattataaagattttgtcttcttttttttttctctgaggtcttttatttagggcgggcttattaccttcttgaatagttgctagaatagctaagagctagccattgctgtagcccatctaaaacactgtccttttttccacaactctctttctcaccagtcctataaatctagacttcagaattagatatttttataataataatgctgataagaatgattaattaagcacctgtcatgtgccacgtgctagacacttaacatacactgtctctgatataacaatctcaaagttagatatttattttctccgtattatcaatgaagaaacaggttcagaaaaattaagtaatttcccaaggtcattttaactagtaagttgtacatctagggtttaaattcaggatacctatctgacttgaaagcccgaatgaggattccccagttatctttacttcagtacatatcacatattggaaaaatcagtgcagaatcagccttgattttgaattcagttgccaactgtgcactgcagttggagtccgtcctgtaactccagttactccgtttctcgggagcaacacctgaaggcatttagtaccttgagatgtcataaagaccacaaactgattgatgcagcatgactgcaccatagcacataatgaaagttgtgcacatttccagtacagttgactacagcatatttctttttgtgtaactgacagtgataggtaatatatgatgtgattctgataactggcatccagttctcactaaagacttggtgaaattagagggactgcctcttgccacgttctcttcttttattgtctacttttgaactatccgcaggtcatttgtatgtcccacaggaatataggatgagtgttttctttctttccaaggcctttaatacaaattgcagaaaattctcttttataattcgattttacatacagaatccccatttattatgttattaaggatgattctttatgttatatctgcagaaagcctcctataaggattgtttttatagaaaggtgatgttttttcagggtcctgcagctgatttccatctctgagctatctctgattggaggcttgtgtcttacagccctcatcaccatcctataagtcacagtgagatagctggaaccatttcaagtctagattttggtagaaaaatcagtgtccagtttagatttcaaactaaaagagagttcttctattcaggatatttagattacatgttaatttccctgtaccgttatcaaactacacttcggctagaacaatttacagtatcacttcccaataattaatttcatactgctgccactagtagttacaaattaaattttaaaaagaaaagaaatggataccttcatattaaccttccactggcaaatgctttttattctccaaatcattgtttcttttatgtcaattttatatttagggaccaacctggctggtagggcctatcaacctttgcctttaaattatctcctaattttgtacctttttttcgtacaccatcattattgccttagtcgaggccacaacttttccctaaatggaacgtctcattccccaaatttggtcttcccctactttattttgtttttctatggcaatatctgactgttttaagatgtttatgtgactcctttattttgccttgttgagtatctagtttttcagttctttcttttagtctttctttagattccctgacttttctttcccactgatgacaccttagtcatcactgcctacaggtccccacacactgaatgaccttctaggggcctgtccttctctaatctcttccccatgtaatctgtcttggatacaacacatgaggtctccttgtgacataaacatctggtcttgtcacttgtccctttgatttcttcagaagcaaaccctgagacgagaaatcaagtgcatatactttatttgtaaggtagaagaagggatatgataaagagtatggaaaatgagacgggaatgggaaagcagccattaaaaggttacattatcaagccagttgtcactcgaagcagctggagcttaatcttcttggggaaactttaaaaaccggtgtagaacacgcacctcgagaataatctcattcagaggactacggagctggagtattaatgcaccaaatttggagcgtcattggttgagaaatgtcggttataatcaagggagagcagtgttaattttctggacctggcctgccccataggcagctgaagaggctttagtggccagaggtaactcaggcaaagaaatacaggtgctggcaattggaagtcagggtagcatgtactgaagtggggaagataaaaatatatggataggacaccaaccgcatatacaattacaataacctcgcagatggtctccctagagaaacaaaagtttattactttatgaaacactatggtattatagtatgaactaaacagccttgtgcatgcgcccttcattttacccatgcaaattgcttctagtcatactctcttaatagctgtaagcactatagaatatgctttgtcttcctagacgtcttttctttcctctgcctcttctgaccacctttcatccatcctttaagaaccaattcaaatgatgtccctctgaagccctcctttctttctctaagctgaatcagtacttggcacaatgtttgagctcagtaaatgtgtgttgaacatattataaacaaacatgcatgcctctactattgctgttgaatgcattgatttataattacttgtgtgcctgtctccaccatcagagtatgaatcatcaaagggcgagggccatgtcttatctatcttatccccttcatctagcacgtaggcacccaatatatgtttatcaaaatagtgaaatgtccttcttagaagaaaatattgaatatttcaatatcaatgctttgaatattttagtgttgaaaacactgaaaaatatccctttaaaactagaataaaacacaagaattagtaggtctacattcccgtcatgcctctgatccacacaatttcatggttagtagtttcattgcctgttttcaaaaaagtgcagggggcataaaatgaaccccaaatctcttaagattctaaaatgttccagagctgtacctatgttatctttgaggaagagcatagagaataccatatccaatgcctattttgtttcattgattggtagtaaaatagaaatatagtataatggcattttcctgacttctgaactctttatgttttttttttcttccctctacagcatctatgaaaggcaaggaggcatttttacctacatctgtgaattttattacatggagaaaattatttacaaatgcagaattatatttttctcagttttgctattacattcatttttctctgtgattccaaagggagtcgaataattcagaggcatgaagtgttttacagtaatttttattgagctccaacacaataaaagtctaagaaagttgttcgggagagtatgccagtagggcctaatggagttgtatttccatttttccactagagggaaattatatcattatattataccatggaggccaaatatttgctaaataaaacacgttgaaatgaatattaaaagcagcgtaggtaaacacctcactccagggactagtcagttcacaaaagaagcagtgtaatcattttagagtaattcagattagttattacttctctgctcaaactcttctaccagctgcctgtcacacgtagaataaaatctagaccccagatatggttcacaggctgtccatgaaccacgaagggcccctgctgtttcttccatcatatctcatgcttctcccttcctgctctctgtactgcaatcacagccttctgacttctgttccagtgcaccagatatgctcctgtgatgggagttttgcagtgcctatgcctttcacgtgggaatgctcagtccccactatgttgttctgcacccccaattcattcagatctgtgctcaatatctcctcctcagagcagccttctctcacgattgatctaaaagagcagccctcatccctgtgttctgtctgctttcttgcatttcttgtctcttagcaatatgtgacattatattctatatttgtttactaatggactgactacccatgagagtagcagctttgtctcttttgatagcataatgccttaaactgtatcgctttagaaacattcagatatttattgaatggatgcatttattgaatgagtaaatgaattactatacctaacccacattcttgtttcagtcatatcctggtaggatcagtacagatttgacgagtgaacagagtatagaaacctaaggagaagtgccttttttttttcaaatgtacttggcaactttggaattttcttctctgtagttatggttgatagtaattgacttcttgttagttttaagacatttaaaacatgaaagctcccttttcctcacaaaggcaaagagccaactgggctttttttaaaattaatgcacattttagcacttactaactggaaatagatgaagtgtgggtcatacaatatgccgtcagctgagtcctaacaacaaccaaaaccttttctgagaaggtctgatttctattttggatatcagtagggtatcctcttatacaaacttacttgtgtatccactctcagtagtaatggtaggcaaagtgctgactcagcagtgttgtgctacacggcagaaatgttgggtgtttttatatctagttctaggtcggtcctttgacacctagccagagccttatagaaagaaattttgaggaatcatttcctcatgaatttgctgtatttcatcagttttatgggagagaaagatgactgttatgtagactttctaggaatcttcatcatactggtaataatcttttacatgggctaaaaatagatgagagtacattttaaaacataaaattccattttaattaaacactctatccatcctagtgttcttttttaaaacatataagcgatatcaaaactatttatgtatatagttttactatgtcagtttgttccctccttttctttaattattcacatttttgttcttttcagatgaattaaacaaaaattattttaccccctaaaattatttcatatatcagaggttagcaaactttttttgttaagggcaagaaagtaaatacttttggctttgtgagctgtgtggtttcttttgcagcttctcaactctgccattgttgcatagaaaatacgtaaatgaatgagtgtggctgtgttccagtaaaactttttcaaaaacaaaaagcagaccagatttggtagtttgccaacccctgttaaatataactgtactctgtattttttagggaaaaagattgtctatttcttgagggtggaagctgtcctatggtagagaatgaagctgtagttaactaattgtagttaaactaattaaaataaaattacataataattgatctaataggaagttaagaattttaagtggaagacattatgtcttgtgcatatccacaacataaatttcattttattttagatagtagaaacaacacaaaacaaaacaaaaacaaaataaacattcccttcctgattattttggtttattttattcggtatgactaatcatatttcccctttggccctgacagaagtaggatctaaccagggactaagagctaagttttgacctctgttacagtagccataattggcctaggttttcctgtaccattatctctcttgcctttatcgacttaattcttttttgaaagtaggtggaaaacagatatgaaaatatcatctgttaataacttttaagccactttttaaagacaagaggcatagagtggatgagaagaaaataatgaaagtagctttggatcagagtaatgtaagcaaagacatcatggtgagactttctggcatattgggctgagttagtattgcaaagcagcaacaacatcaaaagcacattatcactcacaggatgaccagttgcatcagtagaaattaatttgaatttcctaattccttaatagcataaataaataacaagagtttcagttggcattggggtcactattcttttttttttttttttttttttttttttttttgagacagagtctggctctgtcgcccaggctggagtgcagtggcatgatctcagctcactgcaacctccccctccctggttcaagcgattttccagccttagcctcctgagtagctgggattacaggtgcacaccaccacactgggctaatttttgtatttttagtagatacggggtttcaccatgttggtcagactggtctcgaactcctgacctcatgatccacctgcctgggcctcccaaagtgctggatttacaggcgtgagccaccgcacctggctggggtcactattcttgaggagctacttatacggtttattagtggcacaatttagtttaactagtactacttgccataataataatgataattatatttttaaggtgaaaatcactactttgtatgctcatataaattattatattgcactaattattttatctatactaataatgatttactaattaataggataattcttatatattgggaaaaggtatttaaacaaaaaaattattagtattttaaagtataccatctagaacaagccatctttaaaatttttggcttttatgtatatttgattacaaagttactctcatacatatatagttacatatttatattattttatttgctgcaaataacattttctaattttgatttgcttttctttcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtggaaaaaaataaaaataaaagtgatttcacggatg

SEQ ID NO: 1059 - DNA, 30230 bp, mus musculus; identical to SEQ ID NO: 1058

SEQ ID NO: 1060 - DNA, 30230 bp, mus musculus; identical to SEQ ID NO: 1058

SEQ ID NO: 1061 - DNA, 27006 bp, mus musculus
cggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccggaaacccgccagcttggacatctggcactgcgagtccacgctcagcagcggtgagggcctggcgcgccgcgacccctgcctcccgccccggactgccccgcgccccactgccaggacagtcaccgcctgtccccacgtccccgcatcctctgccctggcccgtcccaccccgtccaggcccttctcggatcctggggctcccgccacctccctggcatccacccctcttccctccccatccctggtcgccaaacctaaagcgacagcccacgccctctcccttccccgtggccattcctcctgttctggagtaacacgtacgctattttgggtatttgttatcatttgaggcgagagccatgtggctgtgtaaaaaaatgcgacgccttccacacccccgttaaaaaagaagcaggcaaaaacgccccaactccaccgagatgctgcgggggttcgctgttcggtcttccccactctttttccttcctctctcgaggacgaatttgcctagtgttcacatttctgccggttccactccaccttatctgcgttttcaccaatgtatttcggtttggattttatttccttacgtttttgatggatatgaagagttgagagagggacaggcttgttttcctttccttttttggtgacgccgccgttgattgtgagttgcctttctttctctgccactctaagtaactcttctctcctccagacctttcttttctccatgagctactcacagatgcctagaaagttgtgctttattccgccagcgctgaaagctgcaaatggataagatgggggtggggagtggagaataaggtagctactgaggctaccagtcccagggggctttactgctttccgccctccctgaccctccagttgccttccccggcgccccagttatgcccttagcaaaaatcagtcaacttatgatttctcgctacaaaccccttcctttctaattttgattcttcaactgctggtgtcagcgaagagaaagggaaataaagagagaggacctgccggcgattttctttctttctctctctttctctctctctctctcacacacacatacacagactcacacacacacacatagacacctgagaaactcattacattccttccagtttcatgtcttctctgggactatttataaagctttcctggaaacgtttcaagttgtaacaaagttgaaatagcacaaaaagccacaaaaatctgattttcttttgtctttggtttcctgttataacacaggaaaatttgaccaagtttcttctgtaaatttaattttgtgtttaaaaaaggctttttctttgatactacctcaaaattcccattgaagggtttcctctttgttggttaattcactgtggagggaactggttggcagcaggaggtcaacatttaggtccttcaattctttcagggttggcagtttacaactaaagataaaataaatcggcagaatttctttcttcggtaaccaggggatccaaataaactttggcgaaaatatctcctttcccctcttcaataataaaatttatgtaggaatgacagctactgcacgactccttggcaacgtgaatgttttgcccctttctctctgtctcctgaaataatagacccctgattgcataaagacttttcagataggttagagaaaccagtttcaactcacatttgcttttcaagccagtacccttttttcttggccaggaatgtagggaatggggagaagccagctcgagtttgcagagcaacatacagtgtttgctaaccttttcttaattgcctccatacccatttatctcagcttttttcctctctagtcaaggaaatatggagacgcaagcctaatgcaaatatagcggtaatagcactctgcaaagtaaaaatcaaaggcaggcccagtttgggatttttccctgtttattctacccccttgctgaaagtcatagcccagcgtatatttctatttggatttctgaaaatcagctttcatcttatcttgccttaaaaaaatagttttcagcccagataaagtagaattcataagcaaatgggtaaaaagtagagatgattttgttagaggttttctggaacaagttcttgactttgtgtatatataatagcagttcattttttgctctccacggtgatggtgggacacagggcgggggtggaggaaaggaaacaagatatggaaaattgctctgtgtccccactttacaaaatgtactttcttatgttatgtgaatttgaagcttctgtccgccagtgttttgaaaggaaggggaatgcccgaatcaaaaccagcagtgcttttcttgtctgttccaaagggcaagcagcttttttcgtctgtttgctgtgtggagtagcagaaaacagggagggaaatgtcttctctgaagattttgagagatccacatctttgtctttcaaaataaattaccttgggaggaaccaccaaggacacttttactgaaggcccttcaccaggatctttaaggcttaattaaaaatgtttgtcttaattagaattaaaactgctgtgaagaggcaggcctgtatttactgaaggagcatttcaggaatgtttctactcacaatagtatgccctacttagacccagtttctactgaaactttcccctaagccattatttttaaacttgcattttaattttggtaccaaatgtgcatcatttgctgtttataacctgttttatgattttaagcaaaagtagaaccatgcctcttgtgttctggtgtattgaaggttgcgtcagctcttctagtacgaaccactaatccggttgtcagtcagccgtaatgcttttctctggtgttccaattcaatgtatggaggacagttgaggcactcatcttaagttctaagtgttccagaaagacatatgagaaagcggctaattgactgtgattaatggtggaaagagaaaaaaaaaataaagtgtgcttgttaggaagtttagaatacgcagtactcacatggctgccggccacagaattctttctaagggtagttttccccagtactgttttggggaaccttttaataaaccttaaatcttacacaaattatagtaatattttagacttctgcttagtcacatttagtttgctaactttatttctaggatatagttgctaggatttcacagcaattacaagaatccttagtgtaaataggattggcacaagtgtatacagaatgctgatgccctaaatttgatatcaaatgtgctctataacctctaaggagactttacatttcttctttaaaatgtataaatacatagctatttcatgtaaagcagattgctttttggtgtctgtgtaatttgttgactaaggagaaagcaaggacatacagatggccaaatgaacacttttactaacagtaatttagggatataacaaattcatttttcctttttttatcccaaaatacttgatcaaatagtaccttttttcaagggatattgttaacatcattcacatactatcctaaaaatagctgcatttgtaacgtgagtcattggtagttttgaaatggcagtataccatatgctaataacaggtgaatattatcatttctaattgacaagaaattctttttagagtgctttatatgtagatctttttttaactttagtataaaaagctactttaaaaggaatttataagaaagcctatcttaggtgttaaagataaatggaactgcctaaccacctgcacgtcttagcaaatctgagatatagtgattctgagttcaaacatgtttcatctgttcatattttgcatttattccttaattcgaaaacacagtttcattaggaaacctcacaatgtgatttgctccggggaaggttcagcttgttgcttgaaatgtgttgatattgatgcatttttacaaatagctccgcaagcctggaagtcactattgttatacccacttctggcttccttgaaaagaacataagaagaataaatgcagttttgtttaacctagacatcatagacgggtggacagttaagagtaccagagagcaccaaaactttctccactgataagccagagaaaaccaagtataacttatttcaagatcttcctgatgactttctcttaatgtcttttagattttcaggttccttagatttacttttacaaaggacattttaatgtgtgaacagatataatttctcttttgctcacattcatagaaggattataattcccagggagccacttagatcagtcttggcagctaagggatttgatgggtgtgggaaaagcctggcctttcgtaaaacatttcaaaacaaaacaaaaacaaacaaaagaatatctcaagcaatagattttacttgctgtcgggaatacatttcaagaaatttcctgcaagtttttgtttaatagtaagaccacttgcagagaccatagatatagtcagtgctactagacatgctagtgaaaggaatatagatgcttcaaaatgtgtctctggaatacctaacctaaataccacagcagggagctctctgaaccacttctggttctgagggctaccccaaaataactaaccgaataaataaataaataccacaacaaacttccatgtgagctatgctaaattgtaatgtaattctgtatcagagtagagtagtatgttggagaataaatgagacattggattctaactgacctgaacttggccacttaccaatcatgtgacctcatacaacttaatgtcctcaaatggtttatcataaagattaaatatatgaaagtgcctgtttgttagtgttatgtttcttcctggttacgtattcagaaaatcccagtgatacttttttcaataattgaagatttttcccctttaagtagtaaaatctctgcattgcataatgaattgcataatgaagtactttgtcaatttcaaatttaaattttgatatgcattacctaacatttaacaatgctcttggtagatcatgatcacaaaactattatccttttattcagtcctattacaagccagacacctcagttattcccaatgtcacaataaacttgcaaggtagctaaagttatccctatatattattgaggaaactttggatttttgttaagattaccaaggtctcaattaactagtggtaaagatggattcttaccaagagtattccagttgctaatgctgggaaactaaccacaacaaaagttagtcgtgtaaaataaccattttattatactcatgaattctgtgggtcaggaattcagataggacataatgaggatggatgtctggagcccttgtggaagataacttgaatggctaggaaccagaacgtctggaactgtagggtcattttccaaatgatttcgctcacaggtttggcaccttggtggggaaggctgtgagatactgggcaaagctgtgactctccctggaatgcctacaggtggcctttctagcattgtggtcttaggatattggaattcttacaaattgagtgggtcccgcaggacaagagtcataagagccagaatctctctgaactaggctgagaaatcacacatgtcttctaccacattcagttggttacaaaggagccatatggccagcttggatttaagggaaggagaattgaataccaccttttgatggagcagtggcaagttcacattgtagaagagaatgtgggataggagttgctgttgggccgtgtttggagcacacagtctgacactgagtctaactgcaaatctgcattctttattgcctttgaagaacaacaacaacaacaacaaacggccaaccagtttgtctttgctttgtagcttctgtacttaagaactttgaattgattatataaataatgtctgactgggacaaaaccttccctcagccagcatatggctttaatgactggttacttgtactttggatatgagatggaatgaactcgagaacctaacttttccacaaacagagagatacatgtaaaaccttccaaaatctttggtttagtctcaaacaaccaaggctcaaactgattatgaatctggaatgtaatttgctactttatgttgtatgataaaattttattctttttttagaaagttatgaatgcatctgatgatacgcttgctacatgaacactaaaacattaaaattccagacaggagccaagttttatagtgctagagaagtgttggagttagagttattttttgtttgtttccttttcctttgttttaataacatagctcttctcttaactactgcccatgtattgaatctcagagttgtaacgtgtttaataaaatagacaagatttttaacataatccagtctaatcaaatttattacatgattaaggaaaatgaagaaggatacaatgttaaacactcaatagagagggtacattttgccatagtatttttggagggttggtttttaaaatgttctgtaatattgtagataactgtcacttggtgtttgaagtattgttgaatgatgtcatgtatggaagcttggatgaagaggtgaaggactgcatgtgaaatagctgcccactttttgtaagattatttatcatccatgatttgatttcacatagaattaaagtctgaaaatagaattatatgtgttgataagtacatttcagatgtttattaccatcaaatttacattttaaccatgactagtgcttaaaaataaacacttctactttaagtttctccatgatggggtacgttaaaataatggcttgggggccaggcgtggtggctcacgcctgtaatctcagcactttaggaggccgaggtgggtgaatcatgaggtcaggagttcgaggacagcctgaccaacatggtgaaaccctgtctctactaaaaatacaaaaaattggctggacgtggttgcgggctcctgtagtcccagctactcgggaggctgaggcaggagaatcgcttgaacccgggaggcagaggttgcagtgagccgagatcgtgccactgcactccagcctgggcagcagggcaagactccgtatcaaaataaatttgaaaaagcttaattttttttttaacttttattttaggttcggggtacatgtgcatgtttattatataggtaaactcatgtcaccggggtttcttctacagattatttcatcacacaggtattaagcctagtacccaatagttattatttttcctgatcctctccctcctcccaccctcaaccctcaagtagaccccagtgtctgttattcccttctttgtgttcacgagttctcatgatttagctcccacttataagtgagaacatgctgtatttggttttctgttcctgcgttagtgtgctaaggataatagcctccagctccttccatgttcccacaatatgcatgacctcggttttttttctggctgcatagtattccatggtgtatatgcgctacactttcttcatcccatctgtcatcgatggacatttaaattgattccaagtctgctattgtgagttgtgctgcaaagaacattctcctgcatgtgtctttatggtagaacaatttctgttcttttggtatatacctagtaatgggattgctgggttgaatggtagttctttttttaggtctttgagaaatcaccatactgtactgctttccacaatggttaaactaatatacactcccaataactgtgtataagtgttcccttttctccaaaaccttaccagcatctgttattttttgactttttaatagaagccattctgactggtgtgagatggtatctcattgtggttttgatttgaatttctctaatgatcagtgatattgagctttttatgcatatgcttgttggacacatgtatgtcttcttttgaaaagcgtctgttcatgtcatttgcccgttcttaatggggttgtttatttttctcttgtaaattcatttaagttctttatggatgctggctattagatctttgtcagatgaatagcttgcaaatattttgtctcattctgtaggttgtgtactctgttgatagtttcatttgctgtgcagaagctcttaactttaatttatccaatttttcaattattgattttgttgcaattgcttttggtgactttgttatgaaatctttgcccgttcctatgtccaggatggtattgcctaccttgtcttatagggttgacaacgtagtttatagtttatggttttgggttttacatttaaatctttaacccaccttgaattgattttgtatgtagtgtaagaaaggggtcaatcttctgtatatgcctaaccagttatcccagcatcatttgttgaacagggagtcttttctccattgcttgtttttctcaattttgtcaaagatcacatggttataagtgtgcagccttatttctgggctctctattctgttccattggtctatatgcctgtttttgtactactagtaccatgctcttttagttactgtagccctgttgtatagtttgaagtcaggtaatgtgatgcgaccaactttgttctttttgtttaggattgcctttgctattcgggctctttttttggttccatatgaatttgaaaataggttttctagttctgtgaagaatgccagataggaatagcattgaatctgtaaattcctttgggcagtatggccatgttaatgctattgattcttcctatccatgagcatggaatgttttcccatttgtttatgtcttctgtgctttctttgagcagtgttttataattatccctgtagatctttctcctccctggttggctgcattcctagatattttattttttttgtgtggcaattgcaaatgggattgccttcctgatttggctctcagcttggctaacaatagcttaattttaagttgaaaaagaatttccaaattttgtagaagtcaaccatgtatgtttcttaaattgattaaatgaatattaattttcattcaacaacttaattgcattctggctttattaaaagtatgtattaatttatccaaaaagattgaatgttctttcagcagaatttcaacctcacacattaaaggcactgacatttcaattttactaatcttttcaaactattggttcacctcccttgaaaattagacaaggacacctttccttaatgtttttactcctaagtttgtgtgtgatttgggtacacttgtagatcatcaattttctattctaatcatggacactgaagactctcacttaaaaaatgtacaacgaaacatccatggtcttccaaagaagtgagaaaaaatatctataacacctttgtctctatcagcttgttgactgttatgaggtttaaaatgatattttaatgagccatgtttcaagagatcacatatttatactttctgttcaaaatttctgtttattaggcaaaaccatgttaaaaaaatagaagtcgagacccctgaattacttattctctgtacataaaaagggacagacacaaaagaactaaaattttcatcaaagaagattttattgccatcatgtttaaggtccctaaaccaaatattcaccagaatgctgtcatgatgctctgtgaatgaagcctagaatctattcttagctcctctaggtaacttaaaggggggtacattcgaatgcttccctctattttcccatcttctcacatatactcaatgagttaacttcattgaaacgtagtcattggttttctagcagagggtagacattattctgatacaaagtcagccagttagtctgtgttccaggcatcgtggaaggtagtgagaataaaatgatgggtgaaacaaatggtgtcttttaaacaaattattaataattaaataaatgtgcaaagtgctgtgaaggagaaaacaaaggttctacttctgcagcggggcattaagaaggagctggtgggagtactagctttgccaattttattcctccatatttactaaaggggtatcttaatactatcgtgggtggctgtctggctttcttcattctactctttgattattcttagctcccctaaacccattacagtaactttagttgcttagaggaagtttcacccactcctaatcctggagtagtaggttttctttgtgcttttcaaaataatcaagttttccaagttgtaacctaattaggtttttattcaaagagtgaaaaaagaacaatgttcaaaataccaaagtcatcacaactttgtagaaataccatgattagaaattattattgaaaaataccagtacttgttaggtaacactagttaccatcaaatgcttatgaaaactttcaaagatggtgcatggtaagaaacagcagtcattaggggtgatagtgtctttctttttgtccaaatactggaacttgccttaacagcaaggctctttgctaaatactgtattcaagtggttttatttgaggaaaaaacaccatatgttattgtgtttagattattaattacatttccactgaattatctaagacagaattctgtgaagcagctaaaatgttccattatttgttgaaaataaaaagtatgtgtgtttttttttctaacatcaacataaaacaactccaagatcttgaatgaaattgacattgttaaacactagtaacccatctggcattttggacaaccgggattttccaaaatttggcaaaattaacacgcattttggtcgttagggttattgtatcatctgtttggatggttacctggagtcatttatgtctgtagtttaaaatcaggttagcactatactttggaggcagtctttatctgtgaacgggcctaaagggtagtattcgaaatcaaattgttgccaacctgattactactatggatatctaacatagttgctttggcaaacatctattttgctttgtttgtcacaacacacatagtatttatattgtaattttataaaatacaaataattacttgccttaaattggatggaaaggcagtatcctcatatacaaagaaatatttctttgcaagtgaaaaattatagttttgataccagttttaataaaagaagtggtcattttaattattgaaattagaatcagaattcatttggctgcctttctttgtgtctacatcacagagtggtggaaaattaatgcagtattgacaaatttaggtcagaatgcaacttagccaataaaccaagatttaagctgcctcagtaacgtttcagttttccacctcattagcacatgcagactaacttttaaaagttaagtagatcatttgatacctttagaagtagttaggctaagtttatggttctacacaaaatagcattccattctttgtgtatgaggatacaggcttcctatccaaactcagaaatgcgtagcattaatattaagataaattctttagttacatttcgtgaaaataattaaatgccataatttctgacaaagtgagctagttgggaaaaagacatagtctttggtgaatagatggataatttagggaatgtgagtttgaaatattcttctgtatctgagctttcttttttcctttagtactaaaccatcctactatttccggttcctgatgatagaatgggattggcaatactaacttaactatgttctcaacaatgtaatttaaatgttttgctataaatatgtcctacaaatgaatacaagtgtttagaaaagctgaatgtttgctgggaatgagtgaaaataatccagtctgtttgggtgaattaggaagaatttgtatataacttgtaattcaagatgataggtaaaaaaatcattgttctaagttgtctggtgaattattttattgcagttatagatatcattttagttaatataatttccttttggaggggttcaaaaatgaaaatacaagtgccagtctgacaaatgtgagtgtgatttaaaaatcagtgttttaatttgtgatgagaatgatagaaaagcgagaatcatccataaaaacaacggaatacattgaggggaatactacccacctaaacagtaggacttctgtttatgaggttaaaaacttgtttttccattgctttttaattatatctaattttctaaaggaaataggcattatgtgctcagggatttacatatagtagaaagaatctcagcatataaccagtagctacagaggtaaataaattagccagtgtttgacaagtgaaaggtttctaaatgaggtgagtggaggcagaaagctttaggaactggttttgtgcattgcccttggctcaaaaatatcgaaaatgtatccttgttaaaattttgtcttttctgaaaattggaagtgacttttgatcatgaattccctaagggaatgataattctccaattggacagttataatgtggtccatagaattttcataatgcagtggcgatttcaggccagtctcatatgttacaatgctaaaataagtcagcacaattctgcagaatactaaactgtttatagacattggaaactctgatgccagctaataaaaataccttgaaagaggacttgaaatcagttcctgagttgcatgttaatgttaaacttgatggtgtagtatagggactgcccgatttttatcttgtaactgcaaggggaatataacattatgtgtatgtattttcctggagtttttttttctttttactttttttttcctgttatagaaaacactagtagagaagcatacacttatcttgagcctccacttctttcggtgcagtttgaatgcccccagtgtgtcactgtgtcaattttgccaaaattcttttgagagaacctgacacgtaacatggcagcctgatttcaggtttggttttcagatccaaaacatgcctcccatcccattcgagccctcaccaatttatcaaccaaggatgtatgttatttcctcaaaactgattatcacctgttctctgtggtctcagaaaccaaactcaggtttccaatcagctggcgtgacattgaacaatggcccattttaattgtgcagagcactgcaatttgtaaaacagtaccatgttcattgatgttctgcaggtctggtttgtgtttactgttccactatagtattggtatattatttatagaaaggtagaaaactaatgcagagtaataaatctttacagactcttaactcatctgactaaatactgtgaaggctataattggacaactaaaattgatatagaaattaactgattgtgaaaacttaaaatgcatgacttttttgaagaaatggtgctggaaacagagaattttatgaaattttaatttgttttgcaaacactgagtgtaggttagcaggtatttgtggcatgcaaatcttttggtggaaaagtcagggtagaacaagttttctggtctcttataatattactataaaattgtccaagtcttatgtatatgttcttgctaaatctagtattggacttcggatggtaagtaaatatctgtctaactgtgtcaatgtaaagcccagcctattattttaatagccattagtaggtgtctataaaatatttttcacttttttttactccccatatcttagtcttgttcagtaagagagagggaaatggtaactggctgatttacatagtccttgattttagttcacctcttaggctggcactattatttggacaatggattctagttgtttactgaaagagatatgatgccacaggccctgtttgcagctccaaagtacccacactgaaccttgaaatgcacctcagacctccttgactatgatagccatatcgaaccactttttcagcttcctgatcgaggttaaactgatcagcaatttaaagttttggtgctgggcaactggcctgagtgaatcattccaaatggatataatgacaacaattctaaaacttggcaccattcgccagggatatagtctcaataatccagtctaagccccaggttttggccagaacagtggcagtcatggcccatttctagtttcttttggaaaataaaatagcttttctgtttgagcagtcatatctctggttgtggaccaaaggaaaggtagaaatatcacaacagtggtaatgctgatgattctccttgttgactttacatctagggtaactttgtcattagccacaacctcagtgctgaaaataaacataggacatttagaagaaaatccagaactgattatgtttatctactttttagaagtatttcctgtgctataggaggttctttttctaattaggttctagtcccttttacttttattctcctggtgctttctactatagcattttactggtttttcaaatgaaatgaagaattgctatattgaggaaatgtagcaatatgcgattaggaattttttggaattttctctcgctatattggttaagcatcactttgcactcctgtattattcatttattaaattaacttcattgtgtgttttgtagtttaaaagatctttgcctagaaaaaagttcaacatttgaaatgctaaataaagtataatggttagcaaacagcagctcagccatggagtccaaaccaactcaccacctgtttttgtagattaagttttattggggctgggtgcagtggctcacgcctgtaatcccagcactttgggaggccgaggcgggtggatcacttgaagtcaggagtttgagaccagcctggccaacatggtgaaacccagtctctactaaaaatacaaaaattaactgggcgtggtggcacatgcctgtaatccctgctactcgagaggctgaggcatgagaatcacttgaacccgggagacggaggttgcagtgagccaagatcgtgccactgcactccagcctggatgacagagtgagactctgtctcaaaaaaataaataaataagttttattggggcacagccagcttgtttacacattgtctgtggctgctttcacactatcatgcagagttgagtgggtacaacagagaccataaatcataaatccaaaaatatttctcgtctggccctttatatggaaagtttgcttatcattttctaccttagtctgtctttacaaaatgcaaaacgtgtattttagctatttttttgaggatatttaaaatagagaaaagtgatcaaaattcattcctgtttgaattatggctgaaagtgaagagtcaaatgtgtggcattttttttcacactgagctatgtgaaagagctaatcaggaaaaaacaatctattgcactttcactttaagatattttatatgggtagatatttagttacattttgatttaaatgaatccaatgctttaaagtttttacttatgtaaaataatttagggaaagttgctaacagtaataatcgttctataagagtaatagaccaactagaacatatggagcataggctttcttaatcaaactctccaggaattgcatagatggatggatggatggatggatggattttatttttttcattgtacacttttatataattaaactttgatttttttaattcagaaatttcaatttacacacctgtttttagaaggatttccatcatgccaaagtgcaatataattgtgcacttgtgtaaacttttcccaagaaatttagagacttcaaatgtaaggactatttttttttttttggctttttaattcaaagctacatgctgttatggaataaaaaagcccagtatggctagccttttaacttctagttaaaagccagatctacttttgtttgaagttgtatggctttgttacaaatagatggcattaagaagatgctctccactttgttgtgactcatctttatattttaagaagtttggatttgttcaatttccccttgtttgtttgtttcttgattgcagtgcaagttctagttgagagcctgtgaagcttccacaatttcgtaggaggggaagatgtggaagaggatgcttgagacagggatgtacaaatataaataaaagaaaatcttagggtattggcaattcctctgctcatcgtttatcctaccgtaacaaagagtgcattttggaagctttctggggggataatttcagagggaagcatcaaaatatcatgacttctggacttaggatagaatccattgcaatttaatgatagattaaaatccatttgcattttctgcacttacattaaactgagggccagaagaggcgcttggggcttttaaacaactgctgctctccatagtatcgttttatatgatgtttcccaacctgtatagtactttcatagattcactttgtctcttctgagagaatattttaccattcttatgaatggaaaatgggccagtttttcatcatactatttctacatttttgttttataagaaatgaatgcatttcaataaggtttatgtgtcactaagagtgtgagaaactgtttggaagtatctgtgaacagaggcctgcacatagtaagtggtcaatatatgcttactgtttccgtgtatgaatgaaggggccgagcagccattcagagtccattctggctccctgggaatacttaattttagaaaccacacccgtgatggtaaatacagcagtgaaactagaatcaaataaaaaagaagtggaaaaaacaaacaatattcctgatgctaatttgatggggagttgttttagagggagtggaggagagacaaataaaaactttggagatttttatatggttaaggaaggctttccaagaaatagcaataaaaaaaagaatatactactgtcacatgcagcatggatgaatatgagaaacttaaaagccagacacaaaatagttcataccatttatatgaagtttaacagaaggcagaactcaatctgtggtgacggatgtcctcagtagcccaggtgggagggtcattattgactgggaaggggcgcaagagaaaaatctgggtgatagaaatgccctgtattttaatctggatggtgtataaatatctataagaattcatcaacttctctactttctatacttaagatttgtgaactttattgctcgataaaaatttaaatcataataatattgaaaataggtcatggaggggacacttgatttaacatgaatgcctaatagagtccttggaagaaaatcctagcaaacccctggtctaaaactctgctgagcttagcataggagacttttctgaataaggacatttcctattcatttttgttgcaaaacatttcaaaccccaaaggatgcttagcatgcagtaaaatcacatctgttgagccactgcaaggtgaaggctgctgaacatagttctgttgattctttgaggacttactactcaaaaacaatttcttttttctttccagattggcagattgctactctggctttactcctgggcggcgctgccatcattctcattgcattcctggtgggtttgatttctatctgcgtgggatctcgaaggcgtttctatagacctgttgcggtcatgctttttgcagcaggtaaacagattcattactttcaaatgagtattaaagtttcatgaacctttctaccatcttcctttcctatgcagaagaggtatgtgtttgctgcattacgtaaaaattgagaggcatttactatatttttaaggtaacttggctaaaggtttatcagattatcagttttcagtgtgttaagcatttcacagagcacaatggcagcttctaaacctctgactaaagcatgaacaaataatactgcctgacagggctattaccttaggaattgcagcaggtgtatttactaacagtcttttacatccagttttttccccttttttactgctcccctggtgatcttaaggcagcattattttttctgataaggaactgaaaacaaattccaaaatgtttacccttaaagatgtatatctctttgaaaatgtgtgatgtatgactccaaccattagacaagtcaattatatgaagtcaattgtatgttaattaatttatcaaccatcattgtatgaagcacagcttggattaaaatatcaaccaatgaaatgaaaagacgggactgtttagaaaaggggcttgcagactaaaagcccaatacatgatttgatgtgagctttaattttcatttataaaaatacctttgaatatattgttctttttgactcaaactgcaatattctgtggtgccttcagtttgccctgtcagtcatatctgatttgaagactgcaaagtaagcttctgtgactatcaataatgaagacactgacaaaaccatctaggctgttagatggatttttaaaagctgtttcaagattggaatagatgaaatttctcaggatttaaagggtagttggagctaaaaatacaaaacagaagtgttctgctgccccctactgtttgtgttcattttcttatacccatgaaggctggtcagaattgggggtgtcataaaaatgaaggtccaaagggctgaaggaatccagaagtacatctaattcaaatctttaagtgacttgctcaagatcgcatagtagctactggcagacctgggcctgggaggcttctgaatcttaatctagtggttcattaaccactgacttcctcacttatttatgcaactatttcttagatgcctattacaggctaaacacagtattagacacctataaaactggccacagtatcaccacagatactcactaatagagtagaaagcacaatttcaaaaaatattttgaagtcttagtcccagttattcgggatgctgagatgggagaatcacttgagtctgggagcttgacgctgcagtgagccgacagcacaccattacactccagccttggcaacagagtaagactctatctcaaggaaaaaaaaataataaaagtacctttttctgccgagacatgtgcagtacataaaatcaaaacagacacattactactaccgcttggaaacatctctatccgagacttcacacttacttgatttagtaccgtgtgctatgcctggtactcatatacactcaataaatagtttttgaatgaatgatataaaaatgactaaggcatgtagctcataatctggtggggtaaaacaggcatgtaaacaaataagtaactgtaatgaagggttttttttaagcaatttctcttttggggtcttaggaagcagctagtttcacatgactacaaagctaagaccaaaagacctcaaaaaagtaataaatatcaaaaggatgttttttcatatatttatgtttttatttatttaataaatatgttgggcacttacactatacaagtagacagtcttggtgttataaaatatactctaagggtttttactgaaaactgataattaagtctcataaagatagccaaacagattataaagattttgtcttcttttttttttctctgaggtcttttatttagggcgggcttattaccttcttgaatagttgctagaatagctaagagctagccattgctgtagcccatctaaaacactgtccttttttccacaactctctttctcaccagtcctataaatctagacttcagaattagatatttttataataataatgctgataagaatgattaattaagcacctgtcatgtgccacgtgctagacacttaacatacactgtctctgatataacaatctcaaagttagatatttattttctccgtattatcaatgaagaaacaggttcagaaaaattaagtaatttcccaaggtcattttaactagtaagttgtacatctagggtttaaattcaggatacctatctgacttgaaagcccgaatgaggattccccagttatctttacttcagtacatatcacatattggaaaaatcagtgcagaatcagccttgattttgaattcagttgccaactgtgcactgcagttggagtccgtcctgtaactccagttactccgtttctcgggagcaacacctgaaggcatttagtaccttgagatgtcataaagaccacaaactgattgatgcagcatgactgcaccatagcacataatgaaagttgtgcacatttccagtacagttgactacagcatatttctttttgtgtaactgacagtgataggtaatatatgatgtgattctgataactggcatccagttctcactaaagacttggtgaaattagagggactgcctcttgccacgttctcttcttttattgtctacttttgaactatccgcaggtcatttgtatgtcccacaggaatataggatgagtgttttctttctttccaaggcctttaatacaaattgcagaaaattctcttttataattcgattttacatacagaatccccatttattatgttattaaggatgattctttatgttatatctgcagaaagcctcctataaggattgtttttatagaaaggtgatgttttttcagggtcctgcagctgatttccatctctgagctatctctgattggaggcttgtgtcttacagccctcatcaccatcctataagtcacagtgagatagctggaaccatttcaagtctagattttggtagaaaaatcagtgtccagtttagatttcaaactaaaagagagttcttctattcaggatatttagattacatgttaatttccctgtaccgttatcaaactacacttcggctagaacaatttacagtatcacttcccaataattaatttcatactgctgccactagtagttacaaattaaattttaaaaagaaaagaaatggataccttcatattaaccttccactggcaaatgctttttattctccaaatcattgtttcttttatgtcaattttatatttagggaccaacctggctggtagggcctatcaacctttgcctttaaattatctcctaattttgtacctttttttcgtacaccatcattattgccttagtcgaggccacaacttttccctaaatggaacgtctcattccccaaatttggtcttcccctactttattttgtttttctatggcaatatctgactgttttaagatgtttatgtgactcctttattttgccttgttgagtatctagtttttcagttctttcttttagtctttctttagattccctgacttttctttcccactgatgacaccttagtcatcactgcctacaggtccccacacactgaatgaccttctaggggcctgtccttctctaatctcttccccatgtaatctgtcttggatacaacacatgaggtctccttgtgacataaacatctggtcttgtcacttgtccctttgatttcttcagaagcaaaccctgagacgagaaatcaagtgcatatactttatttgtaaggtagaagaagggatatgataaagagtatggaaaatgagacgggaatgggaaagcagccattaaaaggttacattatcaagccagttgtcactcgaagcagctggagcttaatcttcttggggaaactttaaaaaccggtgtagaacacgcacctcgagaataatctcattcagaggactacggagctggagtattaatgcaccaaatttggagcgtcattggttgagaaatgtcggttataatcaagggagagcagtgttaattttctggacctggcctgccccataggcagctgaagaggctttagtggccagaggtaactcaggcaaagaaatacaggtgctggcaattggaagtcagggtagcatgtactgaagtggggaagataaaaatatatggataggacaccaaccgcatatacaattacaataacctcgcagatggtctccctagagaaacaaaagtttattactttatgaaacactatggtattatagtatgaactaaacagccttgtgcatgcgcccttcattttacccatgcaaattgcttctagtcatactctcttaatagctgtaagcactatagaatatgctttgtcttcctagacgtcttttctttcctctgcctcttctgaccacctttcatccatcctttaagaaccaattcaaatgatgtccctctgaagccctcctttctttctctaagctgaatcagtacttggcacaatgtttgagctcagtaaatgtgtgttgaacatattataaacaaacatgcatgcctctactattgctgttgaatgcattgatttataattacttgtgtgcctgtctccaccatcagagtatgaatcatcaaagggcgagggccatgtcttatctatcttatccccttcatctagcacgtaggcacccaatatatgtttatcaaaatagtgaaatgtccttcttagaagaaaatattgaatatttcaatatcaatgctttgaatattttagtgttgaaaacactgaaaaatatccctttaaaactagaataaaacacaagaattagtaggtctacattcccgtcatgcctctgatccacacaatttcatggttagtagtttcattgcctgttttcaaaaaagtgcagggggcataaaatgaaccccaaatctcttaagattctaaaatgttccagagctgtacctatgttatctttgaggaagagcatagagaataccatatccaatgcctattttgtttcattgattggtagtaaaatagaaatatagtataatggcattttcctgacttctgaactctttatgttttttttttcttccctctacagcatctatgaaaggcaaggaggcatttttacctacatctgtgaattttattacatggagaaaattatttacaaatgcagaattatatttttctcagttttgctattacattcatttttctctgtgattccaaagggagtcgaataattcagaggcatgaagtgttttacagtaatttttattgagctccaacacaataaaagtctaagaaagttgttcgggagagtatgccagtagggcctaatggagttgtatttccatttttccactagagggaaattatatcattatattataccatggaggccaaatatttgctaaataaaacacgttgaaatgaatattaaaagcagcgtaggtaaacacctcactccagggactagtcagttcacaaaagaagcagtgtaatcattttagagtaattcagattagttattacttctctgctcaaactcttctaccagctgcctgtcacacgtagaataaaatctagaccccagatatggttcacaggctgtccatgaaccacgaagggcccctgctgtttcttccatcatatctcatgcttctcccttcctgctctctgtactgcaatcacagccttctgacttctgttccagtgcaccagatatgctcctgtgatgggagttttgcagtgcctatgcctttcacgtgggaatgctcagtccccactatgttgttctgcacccccaattcattcagatctgtgctcaatatctcctcctcagagcagccttctctcacgattgatctaaaagagcagccctcatccctgtgttctgtctgctttcttgcatttcttgtctcttagcaatatgtgacattatattctatatttgtttactaatggactgactacccatgagagtagcagctttgtctcttttgatagcataatgccttaaactgtatcgctttagaaacattcagatatttattgaatggatgcatttattgaatgagtaaatgaattactatacctaacccacattcttgtttcagtcatatcctggtaggatcagtacagatttgacgagtgaacagagtatagaaacctaaggagaagtgccttttttttttcaaatgtacttggcaactttggaattttcttctctgtagttatggttgatagtaattgacttcttgttagttttaagacatttaaaacatgaaagctcccttttcctcacaaaggcaaagagccaactgggctttttttaaaattaatgcacattttagcacttactaactggaaatagatgaagtgtgggtcatacaatatgccgtcagctgagtcctaacaacaaccaaaaccttttctgagaaggtctgatttctattttggatatcagtagggtatcctcttatacaaacttacttgtgtatccactctcagtagtaatggtaggcaaagtgctgactcagcagtgttgtgctacacggcagaaatgttgggtgtttttatatctagttctaggtcggtcctttgacacctagccagagccttatagaaagaaattttgaggaatcatttcctcatgaatttgctgtatttcatcagttttatgggagagaaagatgactgttatgtagactttctaggaatcttcatcatactggtaataatcttttacatgggctaaaaatagatgagagtacattttaaaacataaaattccattttaattaaacactctatccatcctagtgttcttttttaaaacatataagcgatatcaaaactatttatgtatatagttttactatgtcagtttgttccctccttttctttaattattcacatttttgttcttttcagatgaattaaacaaaaattattttaccccctaaaattatttcatatatcagaggttagcaaactttttttgttaagggcaagaaagtaaatacttttggctttgtgagctgtgtggtttcttttgcagcttctcaactctgccattgttgcatagaaaatacgtaaatgaatgagtgtggctgtgttccagtaaaactttttcaaaaacaaaaagcagaccagatttggtagtttgccaacccctgttaaatataactgtactctgtattttttagggaaaaagattgtctatttcttgagggtggaagctgtcctatggtagagaatgaagctgtagttaactaattgtagttaaactaattaaaataaaattacataataattgatctaataggaagttaagaattttaagtggaagacattatgtcttgtgcatatccacaacataaatttcattttattttagatagtagaaacaacacaaaacaaaacaaaaacaaaataaacattcccttcctgattattttggtttattttattcggtatgactaatcatatttcccctttggccctgacagaagtaggatctaaccagggactaagagctaagttttgacctctgttacagtagccataattggcctaggttttcctgtaccattatctctcttgcctttatcgacttaattcttttttgaaagtaggtggaaaacagatatgaaaatatcatctgttaataacttttaagccactttttaaagacaagaggcatagagtggatgagaagaaaataatgaaagtagctttggatcagagtaatgtaagcaaagacatcatggtgagactttctggcatattgggctgagttagtattgcaaagcagcaacaacatcaaaagcacattatcactcacaggatgaccagttgcatcagtagaaattaatttgaatttcctaattccttaatagcataaataaataacaagagtttcagttggcattggggtcactattcttttttttttttttttttttttttttttttttgagacagagtctggctctgtcgcccaggctggagtgcagtggcatgatctcagctcactgcaacctccccctccctggttcaagcgattttccagccttagcctcctgagtagctgggattacaggtgcacaccaccacactgggctaatttttgtatttttagtagatacggggtttcaccatgttggtcagactggtctcgaactcctgacctcatgatccacctgcctgggcctcccaaagtgctggatttacaggcgtgagccaccgcacctggctggggtcactattcttgaggagctacttatacggtttattagtggcacaatttagtttaactagtactacttgccataataataatgataattatatttttaaggtgaaaatcactactttgtatgctcatataaattattatattgcactaattattttatctatactaataatgatttactaattaataggataattcttatatattgggaaaaggtatttaaacaaaaaaattattagtattttaaagtataccatctagaacaagccatctttaaaatttttggcttttatgtatatttgattacaaagttactctcatacatatatagttacatatttatattattttatttgctgcaaataacattttctaattttgatttgcttttctttcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggatt

SEQ ID NO: 1062 - DNA, 61946 bp, mus musculus
gaagccctgaagccagagcttgcttgccaagctctcgctcagaccggatctaggaaatacgaggcgggcctcggtgggagggacgcactgagggaggagggaggaaagggggcggcggcggcggcggcggctcacaccggatcccggccctgcacggcgcgtaccctgggggttcgggcggggaagcggcgccggcccggaccccccgcgggagtaggcgacgggcgtgagggcgaggcggcggcggcggcggccagagagcagcagccgcctggtgagtgtccgcggggaggcccggcacctgcccgagcagggacgtcgggggcgcccccgggatcgtcccagtgaccctgtgcctgagacggtgggcgtgtgcgcaactgcggcgtcccggggactcaccccggcccgggactgcggctgacagcgggaactgcggggctgccggaggtttgcgcagggcctggcgcgtccgcgcccgccccagacgccccgagaggccgaggggagagggagtggctggggtggggtgtcgacttgattggccttggtcccccaaacggaggggacgatgcccttcctcgccggaccctaggcattgcggagagtgagcctctgtggaccggctttaagcccccaggaaggtgtttgaggatgaggactagcagcaccagcgtgggggccgttgagggtgttgagagatgtgaaggttagtagcagtatagtaagaattgttggagaggaggtttccagatgactgttggtaggtgttgagtaaggagaaaacactgctttcctttaaagatcgcacaagcagtcctctgaggtccaacaacagattagagttattcccagttggagttctgtagtttactaccgtgtgccagctcataaagtgcgtaaaagcaggatttgaagggtgagggacaggtgaggcataaagtaagctgcataaaaagatccaaagtttgttaatgtgttaaagtgtaaatccttctgtttctactgaaatgtaacttatttaaattatttaagaaaacttgccacctttggtccagaccgggcttgtcagttcgatgtgtttcttcagtgacgtttgtcaatcaggcagtcattttggcatacagtatatttacttctggtttctaaaagaacaagaatgaatgagaaaagggaacagtttggcaaactgagctttctttgcgcactttttcattttgaaaggataagagaatttacttttttctttgctttagtaatgatttgcagtagtatacaagaacacgtggaagaagaaagggttttttgagatgagagtttaattttgcacagtgttaaattataaagggcctcatcacccatggtaagttttgtgatggtgtgttttatgaacaccggaagaatacaggcacatacatatacatgctttttagtcagtgtgtgatatgaatctttacaaccgtagggacagcccccgcccccacttgcttacaactggcttaatcaagggaaagacttcagtgaaggtaaatattaaatatgtgattttcatcttcacatctgaaagaacataatctgcattcagtcaccctgaattttcatccatatgtttatttgatggagtcttcccctcagttatagataccacattgtgtacagtttgttggagcaaacagagctaacgtcgattatattcaggcactggagatcctcacagctaccctatgctaaagataatgttatgccgattgcacagaacaatactaacctccaatattctttggcgacttcgctgaggagattatatagctggtaaattgcagagctagaactcaaactcatgtaggtctgattctagagtgtgtgttctttcaccatactctgcgtaagtttttgtgctgactgatacaaattttatgaaaatggaaatttgtgttacaaagaaacctttcagttctgttggtaatcttgaaagctttcagtgtccttggctccagataatctcaaggtttttttttcttttcagatgcgtccattttctagccagaggtaacatttgagctagaagtctgctgatctgtaaagagattcctgatagctggtagtgacctatctgaaattcagatattttcagttactttgcctcttgtgtcagcatgcccaagatacttcaaagaacaaatattttgtttattctagtcctgaatagtatttcaaattacattattacatggcaactatctataggggtttgaatttgctttatcagcttggaggtacacatacacatccctgccttctccagcaagtggagtacttgacagctgaccctgtttttcttctctttaataatttgatacaaaggttttggaccctattcatgatttgcagaaaagacggcagctcttctgggatccaccataatctgctatggggcaagggaatgaaagaccttaacaggttcccaggcagtatctgaggtgttgatgaaacagcaggaacatcttgccagtggtcacttttatctcccactggtctttgctgttgcatttcttatgtgctgcagagcctgctcaagagaagggctccacatctgaatagagttgaagtggaacagccacagaaatcagaaaaaaagagaaaaagatactaaatgtctggtagtcatcctccaccaagtcacttagtcaggtttagctgcctagttaattatctctggctgaaagttctagaaaagttttgaaatttggggtttgctgcttcatcttttaagaagtacattgtttgggggccttcagttaagtagtcctgtcttcatggaaacagaaaaaggagtcttgtgttcctcagtacacatcagtatgtgtgtgtattatgtagctttagagactgttttaagtaatcccttggcatcttgatgggcaatctgtggtctgaataagtttttaaatatagttatactcccaagaaagcgttaaataaaatatacttccttacttgtgaaagtaattactcatggtatttgggctatttattagggcaaaaaaaaaaatcaacaaatgataatgtaactgaatgcttaccaagtaaataaagcctttctgaaatgatttatattgccaccgtataaagataaaacaccaggaaattgcctcatatctacttataagtttattttcataccttctatatggtaaacctcaaattattaccatggccacaaatatttatttctctaaaagtgaaatggacttgatgaaatatttggaactatcaaactgaattaatcctaaataagaacatttattatagtttaattcatggacagttctatttgtccaactctaacatcctacttccctccctgcttcaaatttctctactttccatcctctccttctgatgctgttcctaccatttacctggcacccttagttttccattgacactgaagtctttgatagggtggatgctaacaaggaaggcaccaaaactcctccaagtcccttctccaccatcccgtgctctaggaggtcaagagggatgcggataagatctcttaccccaccctgttctttcttgaaaaggaggatgagaatagccaagagtgagggaggcactgtcaagaccctccaatggtttctcctcttcttccctctccttaaacaccaaggaggaaagttggtaaaagcccacgtgctgcaggaacaggcactgtacactcatcctcttcagcaggccgccatcttcgcactgtttcctcactcctttcagctgccatcccccgctccatccttctttcccagttggtcttgccttcctcatccctggatctcctcccaccccagctctgcctttttgccctccttcatagtggaagccgaggtctgtggtcctagggaagctcagacttccagttatgggagggaagatttcctttttctacctccagggctaaatgggtcaggagtagttgctgttatcctaagttggaatgctaaattgattttcctgtagaaacattgcccacacaggttctgtgttttgttatacttctgtaaccttttggacatttaggcttttgtgagcgggcttggaaacctagcatattgatcattgtctcctggaaaggcaaagtctgagtttcaaatagatgattttaaaaatcagcttgtgctccagaaattgttgagggttgcctgctttttgttaattattcactgaaatggtaggtattaatagtacacctttagctgtccagaattagatttatgtggatcagatggctcttgtgggagataaactgataggctttttagattgtcaatgaagaatttctaaatttaggcacatgttttgaaataaaatttaagttagtccatctcagcctaatattgtcattaaagcggacagatcttgcagttttgttgaaagagcatagttttggtttttcataaaaggaatatcttgttcccaccatgaattactgatgatttgaaacttttcaaaggtattggacctcttgcagttattttaccctcatttatttagtgtaaacatgggacagtgtgtttgttttacttcaagattttaaaataaagtgttagcgtgttgaggttacatactgttaccactgtttgtgatgttcagacaattaagtgagggatatgaaggtaataaaaacaaagctaagtacattttaaatttgttttccataaatgtgttcagtcttatattggttgaaggaaatactcctaataaaaggcaagatggtttttttttttttttggtttccaaaccactctttcgtttgaaaaatgactttcagtaagcacgctgtgttcattttaagagtttaccaagttatttaattacacagcgagtgcagaggttaaaaatatgatctcggggtaaaatgcccagatgttcagatctgacactaactagctctgtgttcgtgggcaaattacttaatctctgacctgttccctcatttttgaagggataatgtggtacctacctcatacaaggattaaatgagccagaggatgtatcatatttaaaacatgcctagcaatggtgaatactcaaaaagagttagttcttattattacgttgtcgtcatcattactactattattgttattactttagctactttcgaagatgatacgccttctgttctggggtgtgggcatgaaagatatatttgtttacctggtagcaattttttaatgcagagtttatttgagaggttcagggagagagcagtatgttaactgctggatatatccacaattggccatagtgcaggaaattcatagaatattaagcttatttttttcagtaacaccattccttttgttaggtataaagaactatgcctttttgatgtttgagcaaaactagattatttgagtaattgcaacgtctttattaaaatacagttatcttggtatctaaaggctagagtctgtgcagggggagcctcaatttctaaatgatccattggtaagacttttttttaagcagcaccattttcccacagaaaaatgtcacataatagtgttcagattcccaagccagcccaacatatctgaatttgaatactgatagtattataaaaactaacttttatgtgtaacagtgtctcagcaggaacatgcactgagtacatcaagtactgaaagattatgaacacaatcttgcagatatggcagtagggctatcttcctttgcagtcctagcaaggaccgtcaagccttgggaagagaactctctcctctggtagaggccgagggtaagtagtggagactggtctctagaaggcagtagcttttttctggcttggctccttaaaaggctgtatagtatagtggttaagcgcatggactgtccactcagagtgcttatcttcaaatctctgttctattacttacagaacttcccatctgtaaaatgtaggtaaaagtagtgcctcccttatggggttcttgagaggattaatgtgttaatacgtgtgtagtgcttaaaatagcatctgacccatgagtgagtgcataagaagtgttatgtattttttaattattcagcttgactggtctaggatctctagaatacttttgtctgcttggctgtccactgcccacatcttttgcactaaataggattcttctctttcctttctactgaggaatggtttcagactcttcattcctgcctgaagtattttttaaggggtttaggggggtttattttattttttaatgttggagaaatagcattcttctgtgaacccactccatttccccatttaggccttgtgttgatggagatcatcatttgaagaaagatattgactatgggcatttaattgagtcagaattgaggtgcaaatttctcaacttttagtagtttttgctaagtcatttctttttaaataagctttttattttggaataattttagacttacaatgaagttgcaaagattgtacagaattcctatatactcttcatccaagtatatataaccctggtacctttgtctaaacgaagacattaacattggtacattattgttagtgagactgtagattttactcgattttaccagaatctcactaatgtccttttgctgttccaggataccatgttgcactgagttgttaagtcatttttaattatttgtttttatatcatggagccctccagttctttagtgaatagatttctgtggttgtaaagccattttctgttttagttttaagttttctgcacatactcgaaggctaggtgtttcctctagggatggcaagtccagggatttatcttggcactgaactttataggttgaaataaaaggagagagtcctattactgtggaaagaacactatggtgatggagtgtaggctaaagcatttttataatttaaaactgtgttttcatgggactaaatgagttattttatgcactattcacttttgatggatttgatttcaaaatgacaagtcattcttcctattaaaaaagtgttaagcatacttcttggatatagaagctaattgaaatgaattggagaatttaattttttagtactcatcatagttatgattgatttaataaattaagttagtataatttcagtaatttagaacatttgtttatatgcgcttttagaaaatccttggtttcgatttgtggcaacaatccagtctttttgtttttttcagggataccatatgtaacaggtgccattgttactctaacttttcacacatgccttcagtttgatgtcaaagtcatcatttagtgtaaacagcaagttatctgttaggctgcacatcatgaactttacttttagaaagtcttatcttttatgccacagaaatagcatttggctattagtcatggatggcaaagaaattaattttgagttgtttggataaaaatgtttcagttgactgtagtgtgtattgagagacactgccagtaaacaaactctcttggtaggtggaaatcccctagaagttacagaaaattgggaggaggtgaacttaattaaataacttgaattgtttagacatattcagagcttcttatgaccttgaagaaatcacccaacttcaaaagacctcggtttcttcatttgtaaaattagggagtttgactagatgtgtaaatctagttgttagttaacttctaagatgtaaaaaccctcttgtttaacaaaaacctacaagatcaagttgcttatctgaaatctttatgaatcaacactagtcactaagtctagatataagtcagtttatcaattgggttcaaatagtttcaaaccaatattactgtaagtttgagagtcactagttggtttgacacctcttgtatatttttggtaattagtatattgctttttaaaattttgttatctgatttttgtgctttaccctgaagcaatgaccttcaaacttttttctcatattccctaaacaattttgaaaaatgtactcctttacacttaaaaaaaaaacaaaaaacctcttactgaagtttaatatgcagaaagtacacagaaagtacggtagtgaacaactcagtgaattttcaccaactgagcacacttgtgtactagcacccagatcaagaaattcttactaccttacccccctccacccccatccctgcatattgtcctaacttctaacaccacagattaattttgcctacttttgtactttatctaaatggactcttttgtctctgacttcttttatgcaacatcgtgaatttgagatgtatttatatcgtatgtagttgtagactgttcattctcattactgtatactattccactgtatgaatagatcattatatattattgttgagggatatgtacgtagatctcagtttgtggagaatgtctttgtgaccttggagtaggcaaagatttcttcagcaggacttttcaggagtaattattttacagtttagattggataaggaatgggagaactggtttattgaaatatgagcagttaaatttttttaaatgttaatatgtagttaaaacttgatattctctaaatctcggggagaatgttaatatttttaactaaatcttccaggtaacaggtttgtgctttcatgactattttgggaggaatttcttcaaaaatgtgtcatgtacttctttgtctttttgacttgccgatttgtaggagttttttactatatgctggaaatgagcccttgctggttgtaaatatcttctcccactgtgtggcatgctttttctatttcatggtattctcataagattacctccaaggtattctctcatcttctagaagctttgttgttttggctttcacatatagatctagcatatacctgaaattgatttttgtattttgtgtgaggtaggggataataccgtcttttcctatatggatagctaattttcccagcacaccatttccctgctattgtcaggaatcaagtgtccatatatctgtggttctgtttctgtgctttctgttctgttcctttggtctgtttgtctctacttgtactgatgccacattgtcttgtttattatagttttatcataaaacttgatatctagtagaacaagttcttccacattgtccttcgaaagcatcttcgctattcttggccctttgcacatttctttgattttaatatcatcttgtcattttccacacacacccacaaaacctgttgctactctgattggaactgcatggcatctagagagcaatttgggaagaattgacatctttatcattttctaattcatgaacatgatacactacgccatttatttaggtctttaatttctttcagtaatggttgtgattttctccggaagattgttcacaacttttgagagttttatttgtagatatttgatattttttgatattgtaaatgtttatagccattattttgtttgtttatatctttatattgaccttgtatctaataattttgctcaacttttagtcatatatctttagagtatgtatttgatcttttactatgtattcagtcttcttatctgcaaataaagtcttgtttcttcctttcgaaatgttatacttttgtttcttatcttactgtactggctagtatttcgattataatgcagaatagaagtagtaatagtggcgctattgtcttttttcctttcttgaaaggaaaactttgaacatttctccattaaatatgatgtttactttaatttttttctagctatcatcagattaaggaagtttcattctgtccttagtttattaggagcttacatcatgaatagatactggattttatcaaatgtttttcctattgttaatataaccataggatattcctcaagtcaaattatattgattgatttcctaatgctaaataaactgcattccagaaataaacctagcatggtcaacatcacattttcctctaattttactttggaattttagatctttgttcgtgagtgggattggcctgaaattttgtttttcttgtactgtccttgtcaggctttagtagccttgtaaaatgagctaaggaagatacctgctttttgattctctggaagagtttaggttaagtttggttttattttttctttaaatgcatgatagattttagcagtgaagccatttaggcctagaattttctttgtgggaaagcttttaattacagatgcagttttaaaaatactaatagtattcttcaagtgtttctattttgttaatatctgcttttatattcagtatattttatatacctttttaggaattattttgctctttttctttctaacttcttgagatgggtaggtaggtgtttatacccttgtttccttcctgacatacatatttaaagctatacatttcattttcaagtattgctttacctgcatcccatcatttttgagatgtaatattttcattatttcacaatattttaaaattcccactgtaatttcttttttgatccatgggttttttaaaagtatatttcttaatttccagtaatatgagaattttctaactgtgtattttttgtattttgtttctggctttaacacattttccttagagaactttgagtgatttcaatcttttaaaatgccctgagacttactttatggcttagcatgtggtcagtttttgcaaatatgtaagcacttgaaaagcatatattctgcagttactggacacagcattctatatatgtccattgatcaagtttggtaattgtatcgtatctctgtccctaccaacttttttggtctgcttattcttttaactactgagagagatatctttctttctttcttttttttttttttttttgagatggagtcttgccctgttgcccaggctggagtgtgcagtggtgcgatctcagctcattgcaacccctgcctcccagattcaagcaattctcctgcctcagcctcccatgtaactggggctacaggcacgtgccaccacacctggctaatttttgtaatttttgtatttttagtagagacggggtttcaccatgttgaccagactggtctcgaactcctgacctcaagtgattcacctgcctcggcctcccaaagtgctgggattacaggcatgagccaccacacccagccaagaggtgtcttaatatttgcccctgagatactaatgcatgtctcattctcctagaagttttgtcaacctttgctttatatataatttgagtccatgttatcaactgcatacaaatttagttcgttatattgttctggtgaattaagcattttatgactatgaagggactctttttaactctagtgatcctttttctttgattctattttgtctgaaattaatacagcaataccatctttaatagagcaataccatctttattttagctaatgtttgcatgatatgtgtttatccttttacttttaacctttctgtattcttatgttttagatggggctcttgaaagcaacatatagttgtagattttttttaacccaatctgataatcattcttttttgaaacatttgattcatttatacttaatataattattgacattttggggttaagtacagcattgcatttttattctactagctctgtatttctttttccccttgtctttttcttttatttgactatttttatatcatttttcctttattacttcagacatcacttattcatttttattctttttgtgattaccctagcatttatagcatgtattcttcacttatcaaagtctagtgttaattgatacttctaccttcctcctagttgaagcaagaatattaaagcaccttagttccatttacctaccttgtgacatacatattgttgtcctgtaatttaattttctgtatgtattttaaaccttacaagacattattttatacagtcaatattcctttagatttcacgtgcttatttgaacttcatgggtcttcattcctttctctatctgtgaccttccatcttgaggcagttttcttttgcttcattcttagtgagggtttgctggagatgaactctgtttttatttgtctgagcctgtattttaatttttttcttgaaggatattttctcctcagtggaatactaggttggcagttgttttcttcatgcttcttggagatacacagtcttttagctgccatttttgttgttgaaaattaagctatcaatctaactgttgcttctttgaaagtaatctccccacctctgcccctgctgcccctccatcaggatgctttaaaactttcctttgtctggtaggaattcattgagattgttacacatgtggtttgacaggtttcatcatttttggaacatttattcaaatattgcctctgccccattctgtctcttttccttctgggattctgattaactcttggatattagacctttctcactgtatcttccatgtttcttaccctctcttcattctgagcgttttattttcccccgacctatcttttggttcactgtctcaacggtgtctattggctgttagacctgtttattgaattcttagtttcggtttttgcatttctcagtaataaaattattctttgcttcttttaaaaatctgctgtgtagcccggacaacatggcaaaaccccatctctacaaaaaaaaaatacagaaattagctgggcatgctggtgcatgcctatagtctcagctactcaggagactgaggtgggaagatcacctgagccccagaggtcaaggctgcagtgagccgtgatcacgccaccgcattccagcctgggtgacagagcgagacccggtctcaaaaacacccaaattctgctgtgtcacattttatgatttctaggtcattgctgagatttttaagtttggctttcatctccttgaacatagcaagcataatttaaaatccatgtctgataattccaatacttggagtccttctgagtctcttctggtcatcttattatgtttcctcgtgtgcctgattgtctttaattgcatgctgggcattgtatttgaaaaattatttgaaaaatcatttgaaaccaaggatgatagtttttcagaaaggagtgtatgtgtgtgtgtgtacatctgcttaagggaatccagaaaatccagagttgcttaatcaaatctcagctttagagaccttcctgggccaaccagatgactcaaggccacatcacattcagtgtgtgaactgattcattgcgattcacccttatttctaagttgcagcccttcagggtcccaacccgaaagtgggtgaagaggattttcccttttgtccttctgttttggctctttgacacttttaagaaaggcatttcttatattttgaccaaccctattccttgccttcagatagggaggtgctttgttcgctctttatgggcaggattttcttagaagtggcaaagactgtcattttctctaagacttcagactcagccctagttctgtttaagctttgttttatatagctgtactcacttgtataattatatacatttttaattgaaaggttacattgtatgtgcgtaaatataagtaaattgtttcctgaacactcagcaatattttaagtctcttcaaccttggtcaattgctagaccttgacaatggacaggtttatttaaatttcagctacgtctggaatgactcaaaagatgaaatccctcttaattgctattgaaattaggatgcataatatcaactaaaattttttcctctcatggaagagaatactttcctagttacacttttgcaatcacatcttctgtcttagcatacttatatgtaggtataatatatatctgcccttgtgaaataggaaaaaaaaaaaaggcagttctgctgagattcctagatttctgccatatgagaaccctcaaacaacctaatcaatgaacattgtgctttacaaacttttttccttctatgtaaattaataacccacagcagccttgtgaggtaagtatatgataggtgtgatattaagcaaaggattaggaaactgggcctaagaggttaagtaactcgtctgtcgtcccacacctggtgaatggcatatgttctttgtctgttaatattacagcattgtgtttcagctataatggccaggtaactcttgcctgcatatgctcactgacttcccagttttatcatattatgctttcttctttctgtaagtcatataatatcctgaccccatgactcatgtcctgaagattgagacaattgggagattactccttcatatctcatcctcaccgcctcccaccccatttctagaacatggtaccaccagctctggaatttgccaacctctctgccctgttagaaagcttgctgtgtcactagtcctttctcatccctacacatacagtccctttctctctttttagacatgtctcaatttttccagttctaaaagagatgcgtctttgctttccagttcatttaccgtctttcttggcactcagggcttcctttgttgcttctccagtcactcttgatgaaatcctagccagtcttgtttgccttatccttctgaatcttaagaagggcaaaaagcttatctgccttgtacttcttttccagcaatagagtcaatgctcctatacttctagtgattctgcttctgaaccgccctcatatctcattttcaaatcattgttttcagcatccagcaacatccttgctactcacttgtaatgatagccttgaacaattattttacgttaggcctgtgaatgtcaaatacccttgtttatttgtaggtacttgacatttgaacgttttatttgaacatttctaaatgtacacaaatgaaaggtccaatgaacctctgatgctacagttacatacgttttaccatactagtttcatctccttactcctcttttttccaagaattaaggcatagccaagacataatttcactccccaataatttaacatctctaaaacaacacattttcttacatagctacaatgttattatcttatacagcacatacaatacagttcttaatagcacatataatacagttgacccatgaacaaagccgaagttaggagtgctgactgcctgcagagtcaaaaatccacctgaacttttgttgttgttgttgttattgttgttttgagacagggtctcactctgtcccccaggctagagtgcagtggcatgatcatggttcactgcagcctcaatcccctgggctcaagtgatccttccacctcagcttcctgagtagctgggaccatgagcatgcaccaccacacctacttttttatattgttttgtggagatagggtctcctcatgttgcccaggccagtcttgaactcctgggatcaagggatcctcccgccttgccttcccaaagtactaggattacaggcgtgagctactgtgcccagccaatgtgccacttttgactcccccagaacttaactagtaatagcctactgttgaacagaagccttatcagtaatataaacaattaacacatattttgtatgttacatatattactgtattcttacaataaagtaagctagagaaaagaaaatgttaaaatcatagaaaaatatatttactactcattaagtggaagtagatcatcataaaggtcttcatcgttgtcatcttcatgttgaagaggctgaggaggtggaggaagaggtggggttggtcttgctgtctcaggcatggcagaggcagaaaaaggggaggaggtggaaggagaggcaggcacacttgatgtaactttttttttttttttttttgagacggagtctcgttctgtcgcccaggcgggagtgctgtggcgcgatctccgctcactgcaagctccgcctcccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgcccggccgtaactttttattttattgaaaaaaatccacatataagtagacccacataattcaaacctgtgctgttcaagggtcacctgtacttagtccatccttaaatttccctaattgtctaaaaaaaattcgttttttgatagttggtttgtttgcaacaggatctactcattgtatttggttataccccttaagtctcttaattctcttataatgtataacaatcctctctgctttttttcatcctcagactatgccattctggtgagatattgtttaacttgtttctttatcctcttacttcatatggaccggaaattagatctatatgcttaattaggttcataatatattttcttggaggggtgggcaagagtgcttgtggtcacttcatattacatcacatctggaggcacatatcatctggtcatttcaccttaagtgttgtgaagattcatcagagggttcaagtggtgacagcttgatccctttgtgaagcccaaccttttacttaatgctgttagcatccattgattactggtgcatgaattagttatgtaattaaaggttgcaaaattgtgattgttcaatttggtcacttctgctattattagctgaaatatttatatatggacaaactgctttctcattcacaagagctatttggttaacctgaaatatgtagtcatttattgaattgttaaatgtataactctattattttactaaggcttatgataaagtgattcttgaagaagttaaagctattcctgaatgttagattagtaatttttgtgggttgggtcatggggaaggtcttccaatcctgagcgaacagttctaatcctattgagaaaaggtagggtggcagggaaaaacaaacaaaaaaacagaagaaaagattgtatactctcttcattattgtgggcttgcagtgcgggtgtggtgcttacttggggtatgggaattttaaaaagttcctctactttaccagagactacatcagactcaccacggagtcctttaaattttaaagacctatggccctaaaagggcctcagcacagttttgcaatcaagttcattaaattttaatgactagtacatcttgggaagctgcagggactcctgatggttttccagggatgcagctaaagctcctcttgctagctttctccgaagctaaaatctcaggaaagcttcatttgtcccctctgctgttgtaaagctctaccttaggcactcgaggtgatgagagaggagcaggctggctcaggcagtcaggaaaactttctcttagtatcaattaaacataagtttcattcactgaaatttcatgtagtaaaatggctgcctgctttttcatgaccttttattcatacactatatcacttgctcatactgttgtatttaaagctttcacagtttgaatcttacctcattagccttttatttttcaggacactgtcttcagccttttcttcaagtttttgaccgtggattgtgttgtgtcaaactggatgaattatcttagttgaattttcaccagttgaaaaattggaggtaaggagtatatttcttttttgaaaatgaatctatattactgttaacatgtttacaccctcccctccatttatattctgtgtcctttgtgcacttaagagcaaggatgacaaaataaaagatgtccaagtgatttcatgtgtttagatttaggccctaagagcagcagctgctactgctactactagtactagtactactactactgctagtgggagttacaagttctttggacaattcatttgctattagaaacctcaccagaaaatagaagggtaatttagcagtttattttgaataaaaggggctaatcctactcaggtgccagatccccagcactggagctggtggagattgaaagatctgcccccaagaaataactagatgtgtgtgggatatacgaatcttccaacttcctagtttttgtaatttttcttattctcaaatccatgttaaataactgaattaagcagatggtaaatacagtattatgaacaaataagggtataattttgttagtggtattgtaaccataattcttgctttgaaccattggtagatctgtatcaggaaagactacataacaatatcagccgtgatttctacatagtttatctttctaccttatgaaaatgttcccactttttataacatctgtttcctagtatccagcatgggtatgtgctgtgaattaaatacttaggcaagatgttgtgacacccgtttaataatcttggcttttaacaagttttaaaatccctccagccttcagttatcttcttgtgtgaaatgtttgtatttgggttgagttcagggtttcgcagatttggcactattggcatcttgggctggataattttctgttgtcaggggctgtcctgtgcagtgtaggatgtttagcagcatctctggactctgcctgtcagatgtcagtggcacctttcctcagtatgacaaccaaaaatatcttcagacgttgccaaatgtcccttgcagggaaaagtcacccctggttgggaactactgggttagatgatgtggagtttcttccagctttataattctattgtttttattttaaacaaaaaacctattttttgtaatccagcttaaatgtcatctcttccctgaagctttcctcagctctccttctctttgttctaccttcattgtttctttttctgactacttattatagaactcaaccccactctattataactgccagtgtttctctcactacgaggacatgggtcttctgtatcgccaagcttagattttattaaatgagtgggcaatgggttagaaattgtttagttaatgattataaatagcatttctgttaatctttcaaactcttccactaggaaattcccatagttgtgatcttggatttcagggttaatgagactgattattcattttttaaaaaaatcttttaaatatattagaaggcaggagcctcctataggtacgtgaggatgctacatgaacacatctaggctgcacttgagagaaatcacacagaaattcataacgtgaagagttaagtcatttcaactgtcatatccagagggtttctccagtacttccattttgcttcttaatcagcaagcttccatctatttagaagaaggtaacaaggaaagtagtaatatttttccttgtataacttaaaatatatcaccatatttgaagtcactatttctcaaacccacagtaagaaatacattttaatcgtgatctagtacatacgcacatacctgaaacaagttttttgaatgagtatttgccattactgtgtgtgaaacacttcgatattttctgttatttctttttcttttccccttatagtcatcacgtagtacatttgttatacaatacattaataaatcaaaacccaccatttgaaaaacactgttctaagtaatctctttaagtaataaaatgtgcagatgatctgcttctggcatatgtcaccaataggttgttctatctttcttttaaaataacgtcatttaggaattgatgcaaccaagaccttaaaacaccttgaccagagcaaattagatttccagttattttcaaggcctatgttttgtcatttatatggaatatttagtgtgtacaaggcactgtagccaaaagagcatgtttgattcttgttctcaagatttatagtgaaaaatcctagaggagaataaaaagttaatatactaagtgctgaaagtgataatcaacacacagtgacttttataggcatttatgaaagggagaaaactttgtaggcatttaggagggggttaacataaatgtgggatggcaaaaaacaaacaaaaggctgggcgcagtggctcacacctgtaatcccagcactttgggaggccaaggtgggcagatctcctgaggtcaggagtttaagaccagcctggccaaaatggtgaaaccccatctctacaaaaatacaaaaattagccaggcatgatggagggtgcctgtaatcccagccactcaggaggctgaggcaggagaatcgcttgaacccaggaggcggaggttgcagtaagctgagatcgtgccattgcactccagcctgggtgacagagcaaaactccatctcaaaaaaaaaaaaaatgtggggtggatttcgcattgttgtatcagaaagtagaaaaaagtattacacatggtagaaacagcatttatgtcagtgcacagtgcttcttgctcatacttgaagttagtttttttttttttggataatcaaagtaactgagaaattaaaaaataagaaagtttggtaaactgcaaaattaaatgtatgatataaacacagggtatgttattttagctctactgtggttgtaaaatgaagttgactcaggagatcaattagaaacttgtatgtatgatagctctgataaaagccaatatatgccctaaaatgataatattaacattgaattactaggtttactgagaatgcggataatctctaaatggggagagagagtgctcatctgtcaaaataagtgaataaggttacaattctctctctctctgtctctcccccccacgcgctctctctctctctctctctctctctctctctatatatatatatatatataagctatatatatatatatatatatatataagctatatatatatatatataagctatatatatatatataagctatatatatatataagctatatatataagctatatatatatataagctatatatataagctatatatatatataagctatatatatataagctatatatatatatataagctatatatatataagctatatatatatatataagctatatatataaaagcttatatatatatatatataagctatatatatatatagcttttcactaaacagaactaaacagaaaacagggtttataatagaggtagcatttttcaaaaagttatacacactttgtgctatgcaattaaaaatcatataggccaggtgtggtggctcacacctgtaatcccaacactttgggaggcccaggtgggtggatcacttgagcccaggagtttgagaccagcttgggcaatatggtgaaaccccgtctctatgaaaaataaaaaaattagccaggtatggtggtgcacacctatagtcccagctacttgggcagctgagatgggaggatcacttgagcctgggaggttgaggctgcagtgagccgtgagtttgccactatactctagcctgtctcaaaaaaaaaaaaaaaaattatatgcatgcttcataggcctgggcttaatcctctcttttctaaatagaatggaggctcaggatgctaagtcagaaccaggtgttgacttaagaaaataagcagtggacttgtttttctttttgaacttctgctctcttctgtgggataatgtagaatttagttgctgtagaagatatttctgacctaaaagaaaagaagattcagtttgtaaggatacttgggaaagagccaacctgccctgaaagtgtggtctagcatcctgtctgctgttactttgaggcaccagaagtctactagttttttgttattttccatattgagttgggaagttagcaaaaagataaccatcttttcgttttctcagatttctagactactgaaaagaagttgctttcagagctggagatgtgaataaaatttctgtgccagggttgataaaccatcttgaggtatttttttttctaattttaaataactctattttttaaaacagttttagttttacagaaaaattgagaagatggtacagggagtccccatataccctgcactcagtttcccctattattaacagcttacattagcatggtacgtttgttacaattagtgaaccaatattgaaacatgattattaactgaagtctatattcagatttccttaacttttactgaacatgttttttttcctctttcaggattccatccaggaaaccccatcacagttggttgttatgtctccttagactcctcttggctgtgacagtttctcagacttttgttcttgaggagtactgatcaggtattttgtagactatcactcaattgggatgtgtcagatggttttctcatgggtagaatggggttatgggttttaaggaggaagaccacaaaggtaaagtgccattctcacattctcatcacatcatacaaacagtccatactatcaacgtgacttatcactgttgatgttgaccttgatcacctggctgagaacgtgtttgtcaggtttcttcactgtaatctttttttttttttttttttttaaacacccctttcctgtattgtgctctttggaaagcagtcaccatgtgcattccacacttaagaggtgggaggttatgctccacctccttgaggtgaattatctatgtaaattgtttgggattttctgcatgggaggctccccccacccctcatttatcattcattcatttattcagtcatttctttatctcagtatgggctcatggctatttattttatacgttggatcataatataatactactttatttattttggtgttcaaatttttccagctttgaccattgggagctccttcagttggctcctgtgtcatttcgacatgccctcatcatcatgggattttgattttttagtacttccttactttctggtactacaagatgctccaggctcatcctatatattccctgccccagttttagaatcatccatttctccacagggccttggttccctttattaaagagagaatgcaattagaaatcaagaactgggtgctgggtgtgctcattgctactggggtattgttgcctctatgtcctctcagctgaaatttccgtgtatatagtctatatatttatgcatatttataaatatttttatgtataattttaatgtggcagctaacatattctttgtggggggtgttaagtttaaattaaatatgaatctatcgtttctggaggccatatttaaattgaaaatgtttttgtggattattttaatattatttcagtctcatagtatatctcttgagacttacagaatatgagatagatgcagtgaatatgtgactatttcaaaatggtctctactgtaataaaaatcctataggatgactgtttcataaattatttagaaggcttatttaggggaaataataactatcgtattcctctcccccttgttatttggtagcacctttacatatatgcatgaaaaatcctgaaaatggaactcttatctctgccagtaaaagaccatttgttatgcctcaatatcagccactttttgttactgtttaacttgaagaattcacactgtagtacaaaaactcttctgttttaaaagcaaggtttgctttaaactgttgttaagagttatgacatcatcagagtcttaccaggtagccagtagtacagaagaataatggttaagagcataaccttaaatttgtatcctagctttgctactggttgactgtgtaaccacaggcaatttatttgccctctctgaacttcaagtttccttatttgtaaaacgtggatgataatattacctctctcatggaagtattttagggattaaatgaggtaaagcacttagcacagtacttgatactcagatacggctcagtaaatatgatctaaaatcaaaacctccaaagcagcaaaaaaatagatgaaagtttgaaagctttatactcatatacatactgtgttttgttcaacaattattactggaccagaccaaccagaaaaattaatgattcttttattttgcaatcctaaaagttctctcaagacaaggctaacttttcttcaaacctgggaaatgctcactcacctcattaccttaatatgctagcagtggctgtcagcccaagaaagtattgcctctctagaggccacttgggggtgctactgagattttatgggcggggccagaatgctaaatacctttcattgcctgggatagtcttgcatgacgaggaattcttgtgctccaaaattattgcatcaatagtatgccgttgagacacactagagtacactgatacttaccattgtatctttaaacctttctgcagaacacatttcaggtgtcacaaacccagcaggtatctagatgagtgaagcaaggccaggctgcagtgtttggaatcagctacggagtataggaactaggcaaactgtccttcctaaaaggggagtggtgccttagtttcagccagttgttgcctgcagttgctagatcacgtgatttttcagagaaaagctagatatgtacatttttatgtgatgtctcccagttttaaatgtagctcaactttaaaaaaaaaacacacacacacacacactgtgatggccaaaccaggcagatctgtgggctgaattcattccacagaccattggtttgcaacctctgatataactgtttcaggaagtgacctaaaattctgacagaggtaaaacactctgggccataatggcaccaccctgtttatttgctgagctcaggaaaaactgtggaaacaaagcactagatgtcgacatcattttctagagtgtggggaattgtggcattagagcagagctctgggggagcttcctctctgattgggaggagcaattctgttgggagacatcctagcaattgatttttcaggaacagaaaccactgtgccttgtgttaccagcagtcttgaattagggaggtggctgcaccactgaaggaagcctctgattccactgctaagcatagcatctgggccccatagtctgtcttgcctttaagaaaagaatcctcacaaagctgacatgcaataaaggcttaaaactctgcagaatctcttggttcatgtggcccctgaactgtgtgatgatcatagggtttatgtctttagtgtttcttctttcttgatctagggttaccgcctacacagctccacaatccacagctgtggccatctggactttagtgggggtgtttcaagggtgtcccaggagtttggtcatgcctgagcctagcctgtacagcttagatactgcttgagtcctctgtctggctttaaagtgacaaatcatcattcagcacttattgtataaaaaatagcccattataatgttaagaaacaaactcaatgtgtattttgcttagtagttgttgcctacattgatatatttggacaagaatagattatatgctttgatctgcatggtagccacatctataatatgacactatatgacagtgttttcattttgtttctattggattaaatacaaaagtacagcataatactttactgtaaaactttgtgtttttaaaggaaactgactatattaggccattcttatgtcactgtaaagaaacacctgaggcagggtaatttataaagaaaagaggtttaattggctcaggattctacaggctgcataagcatggcaccaatatctgcccagcttctggtgagagcctcaggaagcttacaatcatggcagatggtgaagcaagagcaggcatgtaatatggcaaaagcgggagcaaggcgggtgagggagaggtcctagagttttaaacaatcagatcttgagtgaatggaacaaggactcacctaggatggtgcttaaccatttacaagggctctgcccctatcatccagtcacctcccatcaggccccaactccaacattgggaatcacatttcaacatgagatttggaggggacaaacatccaaactgtatcattgacttaatttattggctggaatattttctgtttgtaaacagaaagcctcccagtgaacaaaatggaagttgcttttttaaagtattttaacatgatatagttatcaaaaaattaagtttgagagtgttatatattactgtgaaatactaaatgattattcatgtcagttagcgctgatgtgagtgaatgtttgtacagggcagagtgctaaccactattaagattacatacataatcccttaagaaggatatgtgtttaccagtttagattcctatttgttgtgaaaagtcagtctactattaatcatcttttcagatggtagccatttttgtaagctgttggcttccatttgaaagatgctttaacatgtttcttcaaaggaaagtatttataaccattttttaaaaaggcattttcttcttgtgtgtttaaacagctaacttatttgtacaagaattattttttccttccctctcagtcttccacctcaccacacacctttagctccctatgtgaatgataaacttaatgagggtttgctccttagccagtcaaagaaaggcactcatcattagaaatgtctctgatacctactagtgacacagtggaaagaacacagactttggagcaggcaggcgtggatttgagtcatgattctgccatatgttcattctttgagttcattttcttatttgtaaaatggagataatcataactacctttgagggcatattattagctaccagtaaatggtagctaattatagtgataaaaataatggtaaccttggattcagtagcatctgaggtttctgaaggctctgacaaagctaggtgagagctggccgctctcaagatctctgaagtatatggagcctatgcttttgacacctgaagcctgtctgtccgtgttttgattcttcttgccttttcttctagctcataaaaaagacaatggtattgcccttgtattttaaaggcttgtaattaaggttggaaaatgaataaaaccgtttttgggagccattgggaaagctggagttaggcctttggctgcttcagaagctctttattgaaggtttgattaaatagccatgaagtgttctgaatgtggtttagcacctaaaatactgggatcacttcctgttaggaaaactgttatttctgtaaatacaagccgatttgattagttaaggtcatccctaccattaaattcagtgaattccttttttctccccatttctcctaataaatatttattgaacagctagcctgtgctaggccatgtgcctactcgattgtataccctcaaaggagatgttgaattaaggaatctaagagttgtaggtagtcgcctattatttaaatgaagatcctaaagccttagagctgcactgtccagtaaagtagccactaactacaggtggctactgagcactggaaatgggaccagtgtgaattaagatgtgctgtaagtataaaatatacactggatttcaaagatatcatttgaaaaatatatataaaataactgattttatgtagattacatttaaaacaatacttttgacatgggttaaatgttacaattaatttcacctatttctttttaagttggccactagaacatttaaaattatacatatgactcacatattttttactggacaatgctgccttagagcttcagtgacttggtaggattatacatctagctaggactcctttggccagtggaaattataaattgctttactgtgaaaatggaagatagataattcaaaccccattcagaaaaaagttaaattaacactaaggactttgaaataatttacattttaaattaaatcctggattgttaatctggtagcatctcttagtatttcagatttggagttttcaaaagggacaaactggaaaaatatacccattgatttagaagcgtaaaccaatttttttccctatgtgttcacaaattgccctatataggtgactccactcccctgacatttgctgggtggggggatggcaggagatggggggacaagagtcatctaaaaggcttgtctatatatttttctttgaatatgaatagtgttttatccaaatctatcttattaggtagactggtttagtatagtgaaattgattcatcatttaacagatacttgagtagttgggctctgtaaatacagtggtgaacaaggcacagatcttgagtagagctacaggcttttgtttggttagctggtttttgttgtcatttttactttttatttggaaataattttaaactgactaaaaataggagaaagaacaccgcataccctttacctaaatttacctattaacattttcctatttgctttatagttgtctgtgcacacatgcatgtgtgcatgtacacatgtttgtatgtacacatgtacatatatttttttctgaactgtttgagagtaagttgcatgccctttaccactgaatgcttcattgtctaataccgaaaaataggaatattctcttatgtaaccacagcacagttatcaattcagaaaacaggaaattcaatacatttaacattgatagaatacttctaatctaccatcaacatttcactttggtcagtggatccactcatttattttattaacagttttcccttttagtataggatcaggatcaggtaaaagatttagttgtcatggctctctcttttttaacctgggacatttttcaaacctttgtcttaaaatgacatttcctttccccttcgctttttaatagaaaagcccaaaatgagaaatgttctatttcctcatgattagtttcaggttatgcatttctgactgtaatactataaaatgatgtgtttttctcatggtgtcacatctggaggcctgtgcagtccatctggccctcattggtgatgttcatcattttgatcacccagtcaagatgttgttcaatttgtccactgtataattaaatttttcccctttgcaactaataagctttgggtacacacttttaaaactgtgtgtatttcctactcttcatccagattttcccctagatttagcatccattgatgatacttgcttgaagtagtctatactatgatggctgcaaaatgatttttcttccagctccagcactcctgcatgtttaccaattggattttactgtaagcagggacttcccttctcccctatttttgtaggtatgtatttagctatcttcattgatacggacacacggctccctcttttctacaggtttataactcattactgtcttttattattttggtattcaaattgttgcaaatgtggccagtgagtgcacctcttcaagttgacttccaggtccttatatgttcccatcacttcttgagtacttcctcactgtctttaataatgagctatattccaggtggggcttcaggtttttgttttttgttttttttttttaaataggtgagacctttaggtgcatagatggtttcagtatagcgtgtttagtgtttctgtgagggtaagcacagcctgctttggcagcattgtggaggggagaggcaaggcagcaggactaagaaggagtgtcagtggaagcctccttagaggagatgccaccactactgagatgtataggatcaataggaataaagtaaaatatgtaactagacttaaccatactttttttttttttttaaatagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacaggtaagttacctaccagtgatagtgatattaagttctagtttttcctattagagctggtgatgtgtgatgtaattagaacccaggtatgttttcttgtgtgtgtgtgtgtgtgtgtgtgtgtgtgtggagcaggatttccctcaaccttggcactgttgacagtctagcctggataattctctgttgtgggagtcggccttgtgcattgtagaattactaaacgttctaggcatccgaggcctctacccagtaaataacaatagcatccccgcagttgtgacaactgaaaatgtctttagacattgccagatgtctcatgggaggcaaaatctcccaccattgagaaccacagattggagaagaaaataaaagcatgtagcaacaagaaaaacagattctccttatgtttcactttttgaagtttttgggttgtactatcagtccctaagtccttagagttgaattttgaatcttaaatgtatcattttaacttcttagactacacacttttgagtctttttttaaaagtctttagataatccactccctgtttttctaatgctaaatccttaccgatatctaattttaaatgtaagcccattttcactcaccttacctttgttttgctgtgtgtcttacattgaattaaatctcatctcgaagacagaatgtgtctttcccactcaggggacaacaaacagagaagttggcctaccactttccctgtaccccatctccctgtcccactgtccccttgttatgttttatataatccttcacaggatcttagtgttttgggttatggcacttacctatttgcttaactttgggcagcagtacttctaccatgctcactggtcttcctcacacacagtcagtactcatgttcaaactctaccttatggcagtgtgagcagctcaggacataacctaaacctatatacaggtgtggttaattaaaaatagagactcagagaacaatgatggtaacagaggtgcttcctttgtttgcaagccctttactagtctagagctttgggcttatggtttttgtgttacagcttgcctttgctttttctcacacacattcctagcctgaatctcagctctttactttggccccattttggtttctggtagagcaaagacacttcccaccggagtgaaaccaaataaggatgaagcttttagtttaaaccacttcctagcaatcaccttcctcacctatcttagggcccaacctagccctgaccttgttttatttcacttagccctttattacctgcatttttcattaccatttaactaaactgaagaaatagaacttcaaattcagctcagtgaacatttgttgataattacactgtcctaagtctttcacttttttcttcctttgggattaataaaatatattggtatggagatttaccacctactggctctggaaaactgctttattcacattaaaatgtacgaagctcagcagtttgcatttaatgtgcaagccttagagcctcactctggggtgtatcatcctcaatttaggatcactttttaggaatatgatgcttttttgcctcattcctttcaaaagtgttcattatatgtcttaaaaattcttacctctgaaatgattttgatttcttcctcatgtttactgtttgatacattttttatccttatttttctttaaagacatttaacagtcaaatgtgacattagaatctattctggtagttttctttgtacagtacttctgtaaaaataatactttaatatcttggttttgtggttttttaaatttttcttcataggaaaatttactcaacttgtcactatagatatgctgacaattccaactttatatcattttgaatttgggtcctttttgtgacaatactaagtaggctaactcagtgtagagaacatggaatttcagggttattaataaaaatatcagatgttaaagtatccatgactaccttatgtttcaaacgaaactctctagtttttgttttcccctaatccataggtctataaaaaaaaaaagaatactttatttcaccttccatatttttttccttcagatgtctgtcagtgacacattctagttggcaatcagtttgaatcctttggctccaaatttgtttttaatatcttcccttccttgctcaatacgattttcaagcaaggtaaaaataattcaaatctttgagttgtaatggttttcttcaattaatacatctttccgtcactcaaagtattttttgaagtatttgaattttaaattttctatattgattataattgccatttgtcactatcatctgggtagaatgttaatgttttacacgcatgatctcattttttaaagtatttgaattttagtatcaaaaactttatataaagaaaaggttaaaatgatctatagagttttaatacagccaattcattaaatttctaagaattcattttgtaaagatttgctggacttttttttaaacttcctaaagctccagtttaataatgtccttttggccagacatcctttcccttgaaattatcatgtggaaagagcactgggactcaggagaataagaatctagaattggcttttctgttaactagttaagtgcctattgtcaagccatgtaacttcccaggcatctttttcctcatctgtaaatgtgcgttgaattggagcagatgaactctaataggagttctcccaactctaaaattacaacattatgggtcctgttttaggtttaacttcatttggttctcagcagaaatgaattatttcctttcatttttatataaaatgtacttttcctaaaataaatatatagtaatatctatgcatgtacatatctgtgtgtatatttatgaactacagagaaggtcacaataattgggaaacttttatggattacttcaaaagtagtggataatatgtgctttacactagtaaaatagtttggaattctgtatttccttagagaactgctttatgataaattaacattttacaaagagggaaccttttattagtctgattactgtcagttggaacttcaaaagtgtcagtttgctattacctcctttgtgagtgtagaattaaacaattcaaatctttcagtgattttgaaagtataccaagacacctttcagcgggtaaaaacttttgagactgtgagagtatgaatgaatttaattaaggcagtcgacaccaggtttttaattaaattaccctaactcgggcaaagtcatggagccgtagttcaagttatggactttttttatactgattcgttttgcttaaatcttacgtaatggttcagacagttgaagttattcaaggataaatttaggtaaaagaaaaatgagggctgctttagaatttttattgttttaactcttgaggaattttattgtaattctttttctccttttgtggttttagtgccttttaaaaactaaagcatggttatttttatgttttttatcaatttaaatattaataatggatattacttatacttatattgcagcaattgtggtgaatccgagataagcccaacattttaatttgttgagatgcaacaagtataaaatgagtcctggatttggagtcagaaaacttggggttgagtcacagtgttcattagtaggtactttacatttctgtagcagtagcagtagtggtagtactagtaatgtgagctaaatgtttgtaaaataatatgaatcgtttgggtctccttttcaggatagatgaccatgaagttttttgtggttaaaatactgctctctatttattctgtgacagtagtatttgcataactctctggcaaagcctgacttccactattagaatttgttaatgttgccaatgttacttttaccatttttctcccctagaataacaacaatcttgaagcctgttgccgagccctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaaccacctcaacagccatcttccatgcaaacaggaatgaatccgtctgctatgcaagggccttcaccaccaccgccacctccttcatacatgcacatacctcggtatagtacaaatccaattactgttacagtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccatggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaaggtaaattttaacccttttatgaaatttaatttctgtggtgaggcagcagtctcccattcaaatatattagctgtttagttttaattaaatgtttagtattaaatgttgggcagtagcattgctattaagaataaagttagtggccgggtgcggtggctcacgcctgtaatcccagcactttgggaggctgaggcaggtggatcacctgaggtcaggagtttgagaccagcctggccaacatggagaaaccccacctctgctaaaaatacaaaacttagctgggtgtggtggcgcatgcctgcaatcccagctactcgggaggctaaggcaggagaatagcttgaatccaggaggcagaggttgcagtgagctgagatcacgccactgcactccagcctgggcaacagagggagactgtgtccaaaacaaacaaacaaaaagaataaagttagtgcttcagagtcatgtatagactttgttttaaaacatgaaaatgtaggcctaataaggcttagtttagaaagaatattcatagagcgaaaaatacaagtgacatggaaattgtcaaaagtacaaactacagagtaggaaaaaagagattcatggagaatggactaaagttcatcaaacgaaagaatttgaatcttttctaaagaggatggcccagagggcataatgatatttacatataaataatatataagaagtggaattattggattagctaaaaagtaataatatataaaagtggaattactggattagctaatagtagattattggattagctaatagtagacctaaattagatacagagtttttaaaaagtctattcagattgtttcaagataaccggagaatttagttttctttcagtatataagaagggaagtaattattcagtatgcctggtagtcagcctgttcaaaacacacataagtataaagagaatcttaggacaatagaacaagagggatgttcaggtgatgtcactttggttgcattcagagggctaaattgaagcagatgtggaggcagcatagcattagaaagacatgagagtaaatgccaacccccaagttgaatgagtcttttatacattagcagtgcatatcgaaattttccagtcgcttgttcaatgttgttctctgcaatgacattatctataatgctgtagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacggtaagtgatctgttaggatgtgttaataggagggtcgggatattggctgtcaggtcatttatttttctttaggctttattcctggcagagttccggttttttgttgttgttgttattgttgctttttttaaaaacaacagatgaaggacttttgcctttagtagttctcatcaaaataattcatgtatgcagattccataggctcatcagtattttcaaacactgacgattataatcaaggtatagcatctcatttatttgtaaattgctgtcaaaatagaaatgaaaagtgcaccctgaccaaaaatttgatgaatttattctttgtgtattcatttattcttctaagcatatgatatatatattttttaaacatttaaaattaattatttttgtaagtacattaattcagatgagttagatcaatatgaattttggagaagtgttaactgtagaatattttaaggcagagcagttttgttaagtataaataattgtagaaactgagataacagtattgattgatagcagtcttaaagggaactgctctaatgaaaagattcagataatatagttttaacatgttggttaatatatatgagttctaacgatcccaaacaactgagaattttgaagcatgtttaaaatcttgtgacttcacaagcgatgatccaacctatcatttcacctttcaacatttagcagttttgtgcgtatagtttatgcaatgtggtactatgctagatgcttagtacatacctaccagtgggaaaaatagatacatcaacagataattataatacagtgtggtaagtgctgtatatgttcacgggtaatgagagaatttatacatcaactcgtttctgtgcagattcattgcacttctctgctcttacattaatcctcctgctggaatgcccttctaaaaagctctgcacgtgtaaatcttgtctgttctgttcttcaaggctcaacttaacctctactttttccatgaagcctttcctcattttcctaccctctctaagctaagggcaatctctgagtttacaggtttagagaagtgggcatatgtcaggcctcttgcagtcagcatgtctgcagccactccctcatagagaagtttctacttgaggttcttggcttcaaaggggatctgtgaattctctgaaattatatgcagagtttcataagtgtgtttaatatgggaagtgggtctatagctttcatcagattttcataagattattacattggaggaaaaaaggagtgaggaaccattgccttaaacaataggcagagagaaaaggggaaggcattttagaagagaaaagaacaataaggtaatgaaggcttgaagtcaagatggagagtgacttttaggagacagtaactacagttccctggcataagcatgagatttctgaagagttaacagaggttaactggggctttgaccttgaatgctaggtcaaggtgcttgaactttattctcctggtaacagggaacaagtgggagtttttgagagagagagtcttgagaaattggcatattcactaatttagtgacttttttgtaatatcgtgtatagtcaatattagaagtgaggaggaagattttaactacttaaagcactggaaaataacaaagttatctttaatggaaaggtgatgttaatataaatcaaatttctgcctcattttctccatttgaaatcttaattgaatcctctgattgcggaagatattgaaggacataacccatatgggaatccacccgtagtagttgggtactttggaaacctttaggtacctgtagagcataaacaaattttcttagcatagtaattttctttaatcatatacattttatttagcaactacttgctgtgtgataatccctgctaaataaaatattggtttttttttgtttttcattggaagtggagaactgtctaatgtagcataggttagtactaaaaaaaaaaaaaagaaaaaagccccagattttatatcagagctcttattgatgtatcttttttctttctttctttttttttttttgagatggagagtctcaccctgtcacccaggctggagtgcaatggcgtgatctcggctcacggcaacctccgcctcccaggttcaagcgagtctcctgcctcagcctcccgagtagctgcgattacaggagtgtgccaccacgcctggctaattttttgtatctttagtagagacggggtttcaccatgttggccaggctagtctcgaactcctgaccttgtgatctgcccgcctcggcctcccaaagtgctgggattccaggcatgagccaccgcacctggcccccgatctatcttcttgagaaaggaaaaagagaagttggtgaaactgctgccctgggctgtaatttagttttaacttttattataatttcaaagatacataaaatagtataatgaacccccatgtagccatcccccagattgagaaattggtagttcatgtgggtgctaacatctgagagataagacatttaagtgtttcccatgtgtttccattgccaagcctagtgtaaaatggaggacaattgtagtacacagcagagggacagtacgtggtggttgagaccgtgagtaggctctcaagtcaggtgccagtttgaatcctacttctatttgtcactcatgtatccttggataagtaactttctctatgcttgttttcttatctataaaatgtgtggtatagtactcatcttacgggatttttcttaggattatatgaggtaatatatgtgaagcagtttacacaatgcccaacaaatagtaagtgttcttataaaatatgtgttggttgcaaaatactagacaactttgcttgaggtttagacacataaatctgaagcattttatactttgacttcctttgaacttgaacatatataagattatacttatgtaggaaattaatcaagaaataaatcatttagtcagatttcccattttgctcatcaaggctcatttgaggaaccatgatatagtggaaagagagcccacataggcttgggagtcagaattgctcaggcgctcactggctatatctgatttctctgcatctgattttccctagctgtaaaagagaattatagcaagtacattataataattgtcaagataaagagacagtgtatgtaataagcctggcatgaagtatgtgaacagtagatggctagccttatcattgtcccacttgtgtataggaatacccagtggagaattgacatttttgctactaaagcacacattgctaccttcaagttttcaaacaaactgcttatcaggcagtatatacaaaattgattagaaagttgcttgcctaatgatactgcagtgcacatttgtgaccagctatgtgggggagggaggttgtagaaacttagaataacagtgaaataatctttttctaaggagagcagaagtgcaagatataagatgcatgatggtgtcatttcccttaatctgttatttgcaaagcattatattaaatgctgacaaagatgtcatctcttagatctgtatgtgaaatgagataggtatatctgtgagtctatatgtatttgtgtgagagagaaaatataaggcagtaaatcagaagtgttgaccagctaaatggtaacaatataagtactttcagagttttgagatagaaatgttagctttttacctatagagtttatagatggaacagtttcaaggaggagggggaaatttaagttttaccttgaaggataagattttaatatgcagaaagctgccaattaccccctccctcaagttattcccccccattcttcctgttctaattacatttttggactatcccacagctttgagtcccagaggcataactgagtcccagccaccaaagaacatcagtggtctttgacgctggtctatgccagctttggaaaaaaagcttaccattttttattttgaaatgttggctacaaacatcctgttttcttacagacaactttgaattatacatacccaattttgaaattcctcctgcacgaaaactacttttgacaaatggcagtaatttctcagaaactgctttttttcccccctcagtttaatcagaagccatatgaaaaaggacataggaatcttactgataaacccttagtaagatcgagtggttctactatctttggaaatgagcctgttgatgagagtatgtttgttgtttctgagacagagtctcactctgttgctcaggctggagtgcagtggtgcaatctgggctcactgcaacctccacctccccagttcaagcaattctcgtgcctcagcctctcgagtagctgggactacaggcacgcaccaccacgcccagctaatttttgtattttaaatagagacggttttgccatgttggccaggctgatctcaaactcctgacctcaagtgatccacctgccttggccccccaaagtgccgggattacaggagtgagccactgcacccggcctgatgaaagtatgttttcgttacgagcaactgtgtggtggctgcttcactgttttgggccactgtggctgaaacatctctcttgcccccaactccctaaaacctatggaatagataatccttttcaggtgcttgactttcccgacaggttcttccatgtgttcctaggaagatagcatcactgtttggagcccttacattatctttaatttaaatgttcaagtatatattttaaactatttgaatattgcttgataggcaaggcgcaaagcattttacacattaatgtcacatagttttagcccataggaattagaaaaggcagtccataataaatatttctaaacgactttttttgttcctctagcattctgtggaattgtagctattctgccttttatcacttattttaaactttgatacctgcttatttaatgggcattctcagttactctgataatagctcctaacaccatatgaattaagatatcctttctgctcatttttctttcactggcatattaacatatttagcgtttagcaaagtacatgtttttaacagaataggattttgttctgtcttcctatagtagcagatatttaatttttcactttatatgttatagttaaaatcaccctagtatttaatacctgggccgtgctgaaagcttcagtatttcagcctctagattctaaactttgacttttttactatacatatatatgtatatttatatatatacatatatataaaaataaagaaattaaggatgacatgggaagtaaaggcttccaaaaagctttactgaatagaagattaggactctcttcacatttcagtgcctcatatgtgcccctgaaaggcctaaggagtgggctggcctgaagaggtagaggcagaagaaaacaaagttggggaacaaatggaattcatttgtttctgaagttttcatgtgctagagtaactgcctccttcaatctagaaaaaatatgacaaaaatatttatatatgaatttatataggagtcttttatataaatcctggctctaccaattactagctttataactttaagaaaattatataacctctctgtgcctcagtttcctcatctataaactgggcacaatattagtacctaccttaaaggattgttaagaagaaggaatgagagaattctggtaaacaccgtactgttgtaatttttaccaggctggacaagactaagatcatggacatgactcgtttaacaggttgattcttacagtttcccttaccatgaaaacatagacacaaaatattctcagtgctctatgattaaaacggtagtatcttgtatggtagaacacagtccactactgcagctcgccactttatatgcagattttgtttatatgtggccattttgatgtccccattttacccgactattcctttaaaaacatatacataggacttcttaaacatgccctcttatggactaaggccgtattcttggtaatacccaatcattacaattaacatgaaacgcagttcttaaatgttgggcttgataatgactttcccacaattgctattttgggtcctttcttactagcctgaggaaatgacaagattgagaagcatgaacagacaactccagataaatgttgactgtacactgaaagaagttgacctccttcaatctagaggtatagacttgattatttggtaaaccataagtaatagtgtggtattttaagctgcttaaatagcaataactttggttttgtagatttaagagacagtttttatccgtaagattacaatcctgggaaagagatccccctgtcccatggtcatggatcagatttggggatgaaaaaatagttttacttcggcagtttcatcaagttcttatcatttagactgttctatgttgttactttgcatttatcctctttttgtcatttactgtgaatattttataaattgatgggttttaattctaaaacttagtagagttcatattatgtgatagacatctaaaatatctgtaaaaagggatcccaaatcagagtatcagatttctcagttttaaaataaactctatatatgttatttttcatgttatgttatgtgaaaacattcaactataatcatagttttagttttttggatttttttacagaagtatactacagcagaagctctcttaaactttcatttacccaactcaccagattagagatggtcttcattttctgtggaaaatatactgactgatgtccacagctgctgcatacttttgactagtaggctgcattctggtaggcccatgaatattgctcccatcggttgaattgtctgcttaccaagagttgattctgtccccaaacctgtttatgccagttattgtatttctgcaatttaatgtttcataaactgacatgaaggagaaagccgctctttctatgaaagccaaaggcaaatcactcaaaaaatagggattgtgaattagatatgggtgaaaacaactgaaaaaagtctaaaaggattctgtactcaaattgcattataagtgttcttaatatctttcttgctccattctaaagcaatcaaaattatagatgagggttcagcaaactagggcctgttgcctgtttctgtgaataaaagttttagtggagcgatagccatgcccatttgtttacatattgcctatggttgcctttgtgcttcaacagcacagttgactacttgcaacagagactctatcacaggtccacaaagtctaaaatattatctggcccttgacagaaaaggtttgccaacctctgctgtaggtcatcatgggtgtggtttatgtaagaaatacaatatggaaccccagccaacagacacgtaaaaattaggtctttatctaactaactttaaaatatagctatatacaagtgttttgttacgttaaagttgacgtgtaatttttcttaattctgtgtattaatcagctttcctgccccccatcccccacacttaacttttcttgattatggcagctaagactttctacagtgttttaagagtatataataaaatatctcactgccatttttaggcaagattaaacaaacagtaggctgggcacaatggctcatgcctgtattcccagcagtttgggaggccaaggtgagaggatcacttgagcctaagagttagagaccagcctgggcaacatagggagaccccatccctacaaataattttttaaaaattagctaggtgtggtggtgtgtgcctgtgatcccagctacgtgggaggctaaggcaggaggatcacctgagcccaggaggtcaaggctgcagtgagccgtgatcacaccgctgcactctagcctaggcaacagaaggagactcggtctaaaaaacaaagagcgagagattaaagattagtggcaggtgaacccaaaagacacggcattatctgaacaacagacagaagcaaatttgaatgtgagaattgagcaatctagtcaggtacccttaaagtcattttcagaagcctagtcactctatagcccactaacttgaagcaatcaaagaattactatgcatgatgtaggggttacataaactattgctactatattttagaagattgcatcaatttcttttacttgtgtggtctttggagcaaaacaaacagtaaaacatttggttaggatacttatagtaagccttttgtgatctagaaattagaacatgagctgtaacaagtaattgaagaaatacatatgcagcttcttaaagcataaaaagattcaattaatacatcaaatagcactgtggcttttatgagctatcacagcaattattttcagaaaattatcttaaaacagcatattcaagtggataaaacatttgtgaaagggcctgcaagggaaaccactattaaggttttataagcaaagagctgtgttttttgtctgcattggacaatgagctctttgggatacttaggcatttctaaatctcttttcataacgaatctaaatgtatccattttatactaaattctactcttccacactgcagaaaactttttatactgagtttccaatctaaacttttaagctagggaaggaatctaaacctttttcggtggtgacggggggaggcaggggaataagcatttagaatagatgcaaatcagtgcatgacttgatgaaaaccagcttttttgtgatttttggtaaggaaaacttgttgggaaaaaaaaaagtagatctggaaatgaagagatttaatatatttaaactatcagtattagtaccatacagcatcttctataaataagtatggctacagttaactgtaatcgtttagaacaagcagagcacagtgataggttcacagaagtgaaggcaggacccaaaaccaaccttggaggagacacagcaggagatgtggctgaaatacagacactagaccagggaatgaacatttgaagacagacaggtgaaaattttgtggcaagacaaaattctcaggtattgttctatctattctgaaattggcaccttttatcattgataaatctgtaggaaacatttaacacttagtgtaagattctccttttcttgaaaataagaatacataaactgctgatgttatttcacatttattgaggttgcttagtagtctcaaaatataacttgattaatccttgtaaatgtttatatttggctttttctgtagttcaatttataatgaatttttaaggtaaattatgataaatatgaaagtaagctttcattatttaagtgttctttctcacagtttgttcattaaaaatcaaaacaagcagaaagagaaaacagttcaaccatcctttcatttctcttcttcatttatctccccaaatgccccacatgcctaatcctgcctaaggagactagccttacaattagaaaaatattcctttaagtgtaatacattgtagacatacatctgtgtagtggttttcttgggtcttttctcacagcgatgaaaacacaatttcattgggaggacagaattatgtaatgaattttgaaatcctggaaaacatttttcccttcttatgtgttttatttacatattttctttaaaaaaaaatcaaataacaggaaaaaagagttcttaaatgcctgatgaatttactttctttataggaaactttgatccaaaagccatgaataatttttatgacaacatagaacctggcccagttgtaccacccaagccatctaaaaaaggtgagtatgaaaaatgtcacaaatacgatagaaataaatgtcaaaataatttgggatttcacatttatctgaagaaatttccactagaggttaagttgttcagcataaagttaccatatttttattatttttatttttttgagacagggtctcattctgctgccccagctagagtgcagtggtgtgatcatggctcattgcagcctcgaccttctgggctccagcgatctttctgcctcagcctcccaagtagctggtgtgtggcatggtaggcacacaccaccatgcccagctaatttttttttattttttgtagagatgggatctcaccatgttgctcactggtctcaacaaatttaccatattggtgttataatgtggcaataatgaaatgtccccaaactttagtttttaaaaagtactgaaattagtaactcttagaattactgtcagaggtaatttgatggactatataattttttacaaacagaagctgaaacactatattacatagttaacattataaatttacttagcattgtaaaaactataaccctaaaagataattctcataaaataatgaggattttaaaggtctaatgtgagaatagaaagttagatttgcaatagacttaagattatttttcagacaacaaaagaatacttgtgtactcaaaaggggagcatagcaattggtagcgactaggtattttcccatcaagaacaaaagaaatcctatataaccaaggtttgaaggaatcatttttggatagttgttacataaaaatgatttaaaattaaagatatcaaacatgttcttatttttatgtagcaaatgtttaattggcatttctgtatcttaaaaaattaattttaattgaatttacacgtgcagtcatttaagccagacggatggatcacatgaggccaggagttcgagactagcctggccaacatggcaaaaccccgtctctactaaaaatacaaaaattagccaggcctgatggcgcgcgcctgtaatcccagctactcaggtggctaaggcatgagaatcacttgaacccaggaggtggaggttgcagtgagccgagatcgcgccactgtactccagcctaggcgacagagaccctgtcatttattcattcattcataaataagtagtcattgaatgtagattaactttctgcctcattcttaatattttaatcctttttgccttaagcaactcaaggtagattgatcatgaagacacatagaacagtggagaatgccttatttttgaaaaaaattaccagagagtataacatttaacatctcatcagacttaattaaaagaatgtataaattctatctaaataatactacctgacctaattacttaaattttggttgaatagttttctacgtatattaagctcattacagagtgtttttttttttatttataagttgcaacatagtatctgttcttctttttattgtttaatattaccatcgatgtttcatctgatctacatttaaaaacagcctattgatttcttttttttttttgagatggagactctctctgtcacccaggctggaatgcagtggcactatctcagctcactgcaacctccacctcccaggttcaagtgattctcctgtctcagcctcccaagtagctgggattacccaccaccatgcccggctaatttttgtatttttagtagagacggcgtttcaccatggtggcgaggctggtcttgaactcttgacctcaagtgactcagcctcccaaagtgctgggattacaggcatgagctaccgcacctggccaaaaaatagtctattgatttctaaaaatggcacaaagaatcatcttagtggatgactgccgagtgccagatttggcactttggcagcatcatatgcagtttcttgccgaaagtcactgaggtgtatagttagcattgatcaatttagtcttttgggttcataaaatcagtctttaaactcgattttgcctgaatgtctactaaagaagtatcgccagacaaactttagttcattgattcaaagagctgtcttagagcaattgccctgtctaagggagtgcattggaaagtttttaccctggaaacaggaccaagttgattagaaatggtggaaaacacgtgcatcatgagccatccctcagcataaactccctataggtgtggtgtattagtctgttttcacgctgctgataaagacatacccaagactgggcgggcctcacaatcatcacagaaggcaaggaggagcaggtcacatcttaaagagagcttgtgcaggaaaactctcccttataataaccatcagatctcgtgagacttactatcacaagacctgcccccatgattcaattacctcccaccaggcccctcccacaatatgtgggaattcaagatgagatttgggtgggaacacagacaaaccatatcatgcggtctgagggacccaccataaataacaaagacactgccgttactcaggaaatttcaaggttttgagccagggacaaagccagacctctgtttgggcaaggcaaaattctttcccatgcgatagttaaagcagtgcttagaaggaaatttatagctttaaatgctcatgtaagacaggaatatctaaaattctaccttaagaaacaagacaagaacaaagtaaaaacaaagtagaagaaaggaaagtcaatgagatagaaaacagaaaaagttaacaaagcaagtttgatctttgaaaagataaacaaaatcaataaacttcaaggtagactgatctgtaaaaaaagagaacacaaattaccacaatcaaaagtgaaagatgggttatctattacaatgataatgataataagggaaagtgatggacatctttatgcagtaagcttgacaccttagataaagtggacagatttcctgaacaatataatctacccaaactgaaaacaagacaaaacagtaaatattagtaagtgtgtgtttttttaatatatattatatatatatatatatatatatatatataatatatatatgtataaagaaactgaatccactatcaaaattttcccccacaaagaaaactccagatccagatagattcactggtgggtaaattccaccaaatatttaagaaagtaaaaataccaatcttaaactctttgagaaaatacaggagggaacgcttcccgtatttcttttttgttttttcatttcatttccttttcatgttactgagaggaagttgcggagattttccatatacctcctgccccattatcagcatcctacaccagagtggtacgtttgtaacaattgatgaacttatattgagacctcataatcactcagagtccatagtttacattagggttcactgttggtgttgtaccccatctttttttatggcgctagcagaactctgattctaaaacctggtaaagacattatgtatctgcccctcacaaaaagaaaacaaaatttcagatcaataaacttcatgaacatagaaacaaaaaatccataattctgttttctatctcattgacttatagtcactatataaaaaaagataatacattatgaccaagttgagtttagcttaggaatataatcttggtataggcattaaaaaaccaaccagtgtaatttaccatattaaacaaagggaggaaaagcatgtgatcgtttcaccagatacaggaaaaacatttgacaaaattcaacagccattcctgacagacaaaaactttaaacaaattaagaatagaaaagaactctttcagtctcataaagggcatctttcaaaaacctttagctgccattattactgaataatgcaattctgaacttaccaacattgggaacaaggcaaggatgtctattctcaccacctttattcaacgttgtacctggagttcctagcccatgcagtaagagagaaaaaaaaaaagcataaatattggaaaagaagaaataaaactatatatactacagatgacataattatttttaaaatcctaaggatactggaaaacaactaactattagaactaataagtgaatttaacaaggcctcaggatgcaaagtcaatatataaacatgtttttacaatatcagtaaacacttggaaaataaaattcaagagaatttcatttacaataccatcaaaaaccatgtaacacttaggaataaatttatccagagatgtatacattgaaaactataaaacattgtcaaaagatatttaagaagacctaagtaaatggagtgatataccatgttcattaactgactgaatcaatatttttgagatacctgttcttacaaggttgatatatagatacagtgtaataccaattataaccccattaggtggtagtgcatttttaattaacaaactgattataaaattcatatggaaatacagaaagtcctagaacatccaaaacaatcttgaaaaagagcatccagaagtcttagactggctcagtgcaatggctcacacctgtaaacctagcattttgggagaccaaggcaggaggatcacttgagctcaggagttcgagactagcctgggcaacatagacctcatctacaaaaaaaaatttaaaaattagccagacatggtgtaattaaaagtgtatgaaaagtgtgttagtgtagagctaatttaaaaatagctcattgcagcctcacctatagtcccagctattctggtggctgaggcggtaggattgctggagcccaggaggttgaggctgcagtgagccgtgattgcagcactatactccagcctgggtgacaggctgtctccaaaaaggaaaaaaaagtcttagactaaccaacttcaggacttactataaagctacaataaccacagtgtgatattggtataggaataaacaaatagatcactggaacagaatagggagcccaggtttataccccccagtcacactgtcatttgatatttgacaaaagcaccaaagcaaccaatagacaaaggaacatttttttcaacaggcagagctggaagaactggatatccatgtggaagaaacacacagtctgatctctacctacctcacatcatacacaaaaatttgagatagctcatacacctaagtataaaagttaaactataaagcttccagaacagaatatctttgcaatttaggtataaaagtttttggacaggtcacaggaagcaataaaaagaaaaacaattgataaattagtcttcattaaagttttacacttctgctcatcaagtgacactattaagaaaatgaaaaggcaaaccacagaccaggagaaaatatttgtaaaatatgtatctgatgaaggatggtatccagagtatataaagaatttctacaacacagtaataaaaagacaactcaataaaaaagggtaaaacacttgaacagacacttgacaaaggaatatatatatgaaagaccatgaaaaaagaaatatcaaggaattttcctggggtaatcagatggatctgctgccaggatcctgtatagtcagattgtggttttctagcaatggtgatgttcgtgttaatatgtcattctgaggccagccttgtggctcatgcttataatctcagcactttgggaggcctgggagggagggaggatcacttgaggtctggagtttgagaccagcctgtccaacagggtgaaactccgtgtctactaaagataccaaaattagctgggcatggtggcgtggacctgtaatcctagctacttgggaggctgcggcagaagaatcacttgaacctgggaggtggaggttgcagtgagccgagatcgcaccactgcactccaacgtgggtgacagagcaagatgctgtctccaaaaaaaaaaaaaaaaaaaaaaaagatgtcattttgccttctgtctttgggaccaacaccatgtattcgaggtgggaggttcctgtttggtatcctccttggctgggcattgaataaggcttgcattaatattccatgatgtggtcccattaatatcaagcttcatctagcgctctacaagtacctttacactaaaaagactttgtttgtttgtttttgttttgagacagggtcccgctctgtcgcccaggctggagtgcagtggcatgatcatagctcattgcagcctcgacctcccaggctcaagccatcctcctgcctcagccacctgagtagctgggactacagacgcacaccaccacgcccggctaatttgtgtattttttgtggagacagggtttcgccatgttgcccgggctggtctcaaactcctgggctgaagcgatcctgctgccttggcctcccaaagtgctgcgattacaggcataagtcactgttcctggtctgaaagactcttttctatgactcatttaactcaaacacaatttgcaaaaactgatagtcccttagagttagttataatgggatttcggttaaaatttcttaaatatgtattgaatgctcaatgcgtagctcaattatgtagatagatgcttgctgttacacagggaaaacatgactcctaccccaagcagtttaatattctacatatgtacacttctaataaaaaagagactaggaagccatctcagtcatcttcactataaatgaatttctattttagaaatttagtagttgtaattctataataatatatattattggtgaaagtataaatggttctattatatgccaaattgtctttaacccgttttttatcttcttctgttaaaacttagaaacagtagaacttgattaaattctataattttttggtaagcctttcatcacaaatttataaaagctattcagttttctccataaaatcaagtttgttttccattaagcacttgcagattctcatattgtatttgaaactaaatcggcgttttctaaaagtacatatagtttagcacagattggcctgctattgcaggccactcaaatacaaaaagaaaaaagataaaccagtaaaacacaaattactggtagaataggtttattggttcgaataaataaatgtcttggagttattacagatatataccagaaatccaagtgtaattaatatagtttatctgaattctaagtgtgataattaaagaatgtgagggagacagaaggaaagagagagaaagagacagagaaacaaaccttttttggattggactttgtagttaagcaatacagtgtgtacgtgctcttcagcgggcttagaatgtctcccaacccttattagtaactcataacagtggtagattggactttgtagttaaacaatacagtgtgtatgtgtgctcttcagtgggcttagacagcttccccaaccttcatcagtaagcaagcaagcacactgaccttggtgtcccacgatctgagcactggtcctggtcatcttggccacctgaccttgttcaaactcaatctgagcaccatagagggacaatccagccaaatactccaaaggttgtaagagttagtgagataaggtatgtgactcgacagaagtactttgcaaatctaagaaacagaactttaccttattctttggagccttaaggagacattcactctgcttttgtttactcagacaatggagtatttaagtacctgagcaccatgctttggattctggagcagtgatttccaaagatgagttgtactgtgggctcagaattcattagaaaatgcaagatctttctttggttcctaagggcaaataatataaaggctgccatttttcatttttaatccaaagggttgcttactaataaactataaatttatagaaacaattttctagcaagatattaggatgcctacagttcttgtctgtgttgcaaagtgtctgctgggcttctgcacacataggtaattggaattcaggaaatgatttgggagcacgtggttgtcagtatatactattatatcgagttggttctgatttttcaagtactgctatttttaaaaaatccaccagacacagtggctcctgcctgtaataccaacactttgggaggctgaggtgggaggatcacttgaggccaggagtttgagaccagcctgggcaacatagcgagagaccctgtctctacaaaaaataaaatttaaaaaattagctgggcgtggtagtggcatgcacctgtagtcttggatacttgggaggctgaggcaggaggatcacttgagcccaggagatcaaggctgcagtgagccattattgtgccactgtactccagcctggacagcagaacaagaccctgtctcaaaaaaaacaaaaacaaaacaaaaaaaatcctgtcattttcatcacatttcatcattgtaatagccttactgtatggatagtgcccataattttaaaataatttttaaataattattgcttaatcagataattgctaaagtaaaatttcccaaattttgctttcacatcgacatttatttgctatcactgagtttgtacccctaatccattaaaaagtagaaaacagtgaaatagggcatttgttctaagtaatgggagaagatgtaactggagaagatggaaaaaagttgtaagaaccactgctctgtataggttgtaaaagcagtattaaatatggtgcctgcccttgctaaaggtaacatgaagtaataggtagggtaaatgcactcagctgtgtgggttgcttgaaagatcttgtgagcctgttcactcttgcagttgaaagactggatcacttctttctggcgttgtttatttttatgcagactcctcagacccctgcacaattgagagaaaagcccgaagaattagcgtgacctccaaagtacaggcagacatccatgacacccaggcagcagctgcagatggtttgtacttgtgtgtccagagtttgtgcagaatgtccaaagacacatgttaatccatgtagaattataagtaaaaccatacctttattttttgctttaaaaacattaccgagtttctaaggctgtgctgtccagtagaaatataatgcaagccacatatacaatttaaaattttctagtagcaaagatgaaattaatttttttttttttttttttttttgagacggagtctcgctctttaggccaggctggagtgcagtggcgctatcccggctcactgcaagctccgcctcctgggttcacaccattctcctgcctcagcctcctgtgtagctgggactacaggtgcctgccaccacgcccggctaattttttgtgtttttagtagagacggggtttcactgtgttagccaggatggtatcgatctcctgacctcgtgatccacccgcctcagcctcccaaagtgctgggattacaggcgtgagccaccgtgcctggccaaattttaatatatttttatataattcagtatatacaaaatattatttcaatatgaaatcaatataaaattatcagtgagatgttttacatcctttttatactaagtctttgaaatgtggtgtatattttacacttatagcaacattgagtttttagagcatgtctattaaaaaccagcaacagtaagatacgaatttttttttaagtgttacgtttttgggcatattgttcttttaaaaggtaaagacaaaagaggtccttttctgaaaatggcatagtaggccgggtgcggtggctcacacctgtaatcccagcactttgggaggccgaggcaggcggatcacgaggtcaggagatcgaaccatcctggctaacacggtgaaaccctgtctctactaaaaacacaaaaaattagccgggtgcggtggcaggcgcctgtagtcccagctacacaggaggctgaggcaggagaatggcgtgaacccaggaggcggagcttgcagtgagccgagatcacgccactgcactccagcctgggcaacagagcaagactccgtctcaaaaaaaaaaaaaaagaaagaaagaaaatggcatagtaaacatttttcctccaaccgaaggctttattcctccatatgagacaaaaaagaaaactgtattaaatctacatgttttggagtcatgagccaaaagacacaaggtgggtgataatggcagttaaaaagcaatagttgaagcaagagaaacaagcccatctcctatttatagtcataggaagcagctgaaaaacccagtaattttctgttatatcctaaggctaagatcaccttcctgtttgaggctgagcattatcataccttggggtaaggttcagggtctaaaattcagttctccttatctcttggggaatgttataacatttgtcatataaggcaaattgataaactagaagtcagcttgttaatttccagtggaagatatgcctagcccaaaatagtaactgacaaagcttccctagatctgtttcttttgttacctatttaaaaaggtgttgcttacctcagatcttaatctcatttccagttaccccagattccagggtgaattccatctggagatctttagtctcctatttattgacctcagtctcaatagagacctaaaagacagaaattacaggttaactctagatgcaaagagcttttttgagcacaaagccagagggaatgaggacctaagaggaatgtaagtttggatatctttttcaaatcctggggaccaacataaggttgccaggtatgggcatttttaaaaactgatatatgaaggatttttaatgccaaaaatgtaggaaagaatatgagaataaaagtcttttatactgaatgaatttagctttatgaaaaatgaactgtagaatcttcctcttttcactattctgaggaaaactttggtatgaactgccactgctatttatgaaccattaatataaaacatatgcatattgtagagcttaagttgtcatggaagaaggcacacatttagtcagatgtttaatatagtgtggatagtattatactatagagaggaaaagtcaaggtgggctgaagtcagggaaaacttacagaggcgacagaatttaacatgctataaaacatttctctttttcttcatttggctggaataaagcataactctccgctatttacaggtaatgacctaggaaggcaatctattctggacatatatccatcttcttatagcagaaaaaaagtaattagaacaaagtaaaagatcaactttctgttcaactatgcatttccagtagatatatttactaattggcttacatattaaagtaggcaattacctcccttgatttttgtggtatttttcttttcagtttggattatacttggaaaaaggttaatctatttaccttccccctcccccttaatcctaacctccctcagagcatcgaactggctccacacaaagtcctcggacacaacctcgagatgaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggccttttttttttccttccaattttgtgataaattcatgatgtttacagcacagataaaactttgtgccataatcctaatttagctgaaatcaatattaactgttcaataaaaacttacttgcatatgttaacaaaccagtgtgaggggaattacagttggccaacgacaaagttgcacactgcattatttaggaaaggagggattgtcaaaaattattaagagaaaggtgaatatagaggactttgaaacaacttttaaaatttaacataactgtatctagaggtcaattgagtctctacaggcagttcagatcattttaaagcactccttatttatgaaatagaacttcagggtgcggataagagatataaagtcatgtgactcactagggtgcatcgctggaaacttaatagcacatttcattaaggtctctgccattgttggagttccttcttagctcagaattggagttttggaatcttcccctcattttggtgagtataaacagcaataaagttagtaggttctcccatcctaaaggattttacctgaggatatcgtcttaggaatatccatagacgctcccatcaggtttctcccccaacccccctacaccgcccccccacttctaatttagcagtaatctctggcagacctggaaaaacaagctgctcttaatagcataatgaaaccaaaggcgtaataactcatcatagttttccatcagaatcatttcacactctgcctacagctttgaaaacattttttcatatgtgaaaaactccccaaaatatatccactagtctcccaaaggaagcatggtaattaacactgataaaaacatctctcacacaacaactgtggcaaaactgtgaaaataacggtgagaaagcagatgggcttaaaagcatggtccccaaaacaacgttcttcaaaggtttttgtaacactggtctctgtctccaataacagtctagccgtcctactgttctgtaatatgcctttgcctttgtatggtttcatatctctttagtgatggtcaaccccacttggttttaagttacaatttaggggaaatatatatatatatactgcttggtgtcctagctaaaaggtttaccagtattcatagtgatatgctgaagtggaggcaattaacttggcagttgtcagttgagaatgaaagtagcatgtctgaaaacagtctgatgctttataaaaccatgtagatgactttaaaactattgcatgaaaatacatcaaggttaataagctgttatacagtagatgcatggtttcaatcctttggtgatattatctagtcaatcattgttttcacctgccaggaaaagagagaaaacagtctattggataggtgtaaagggtggggtatgcggtatcagattgattttaaggaagttttgtacatgttaatttttaattgtgcacaagtttcatatgccaacataggctgtattcagttttaaaataggcaaaatgacttgacactgataaatctggtatgtttaactgtgtcccatatgtagactgctttttgcctatgaccagtttgaacaagaattcacccaactttcaagatgccttttcaaaaggatcttgtagtcagttggtatgtacagacaattggcatggaagtggtaggatataaatcggatgacgcctggctgctgaggtgccagctggatcagctggtgcacttcttgtttcttgtaagaggtttctttaaaatgactagtttgatgtatctggtaacatataggcctgactatacattttacattatttcgctattttgtaaactgggattttagaaagcacgtttgccattttgttaaagtacattgccccttaaattttggagtagtttttaaaagtttaaaatggtaatagaggagccagaaactttttaagcattgtaaaatgttttgaattgatattgactttgtttggaagagagtagaggcagggggctttaaagaaacaaagaaatgcattgtaaaaatgtagttttagagcaaattaataatgatggtggggaaagtgttgctaatttgtttatttccctggaagaaatgggaagtgtgataagcagtttaatttttaaggagctggtctcaattttagtactttttaattatgcaaataaatcaatgtttccttaaattttgtcattgctttgtcacagttgtctagggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatgttacttttaaaaatcagaataaattgggcactgtctgtgttgcaccactactgtatcttttcgaaagaattaacagtatttgcctattgtaaaggttaattctgatgacgttttcacattcaccagactttttttcctgtattatttgcatccccaaatatttaatacaagtagattctgcatggcttgggcattcagagattaatagaatgatgactcaattttaattctaaagccatgaaaagttactttgagactgaacaattctgaattatttatgatacccaatgtccatgtttctttccctactgtaaaagaattgatcagtttcttcattaaagcagcaaaaacttattaaatcttgtaaataccatgtctcttttagatttctgtgtatgctgtgaatgaaatcattttgagatgaaattgtacaaaggcattttaaaaggctctgcatgcatcgtacctccaaacagtacatattcggaaagtcaaagattcctgcaaaataaataaactaaaagcaaacacta

SEQ ID NO: 1063 - DNA, 61946 bp, mus musculus; identical to SEQ ID NO: 1062

SEQ ID NO: 1064 - DNA, 1038 bp, mus musculus
atgcctcggggtcagaagagtaagctccgtgcccgtgagaaacgccagcggacccgtggtcagacccaggatctcaaggttggtcagcctactgcagcagagaaagaagagtctccttcctcttcctcatctgttttgagggatactgcctccagctcccttgcttttggcattccccaggagcctcagagagagccacccaccacctctgctgctgcagctatgtcatgcactggatctgataaaggcgacgagagccaagatgaggaaaatgcaagttcctcccaggcctcaacatccactgagagatcactcaaagattctctaaccaggaagacgaagatgttagtgcagttcctgctgtacaagtataaaatgaaagagcccactacaaaggcagaaatgctgaagatcatcagcaaaaagtacaaggagcacttccctgagatcttcaggaaagtctctcagcgcacggagctggtctttggccttgccttgaaggaggtcaaccccaccactcactcctacatcctcgtcagcatgctaggccccaacgatggaaaccagagcagtgcctggacccttccaaggaatgggcttctgatgcctctactgagtgtgatcttcttaaatggcaactgtgcccgtgaagaggaaatctgggaattcctgaatatgctggggatctatgatggaaagaggcaccttatctttggggaaccccgaaagctcatcacccaagatctggtacaggaaaaatatctggaataccagcaggtgcccaacagtgatcccccacgctatcaattcctgtggggtccaagagctcatgcagaaaccagcaagatgaaagtcctggagtttttggccaaggtgaatgacaccacccccaataacttcccactgctttatgaagaggctttgagagatgaagaagagagagctggagcccggcccagagttgcagccaggcgtggcactacagccatgactagtgcgtattccagggccacatccagtagctcttcccaacccatg

SEQ ID NO: 1065 - DNA, 50718 bp, mus musculus
gcgcgggccccgcgtgggtcctgccagagatcacctcggccccttgaagaggcagccaagctgcggcggcgcaggagggggcgggttcagcgagggcgcggcctctgagggggggcgcaggacacgcatcccccgcgatcgcccgggccactcgggagcctcgcggcagcccggcgccccacttggccatccgctccttgcccgcctcctcttgtcacctcccgtctcatccttctcgctccttccccgccgcatacaccggcatccgagtgcctcagagagccggaggtggtgtgcggggctgcagggcacgacttcaagcggtcctcagctccgcactagggggcacgggcaacagcatggacaccaagcgctgcttcgccaatcgcttcgatgactaccagggcagcctgctggcgggccagtgtgaggaggcggtggcgcccttggtcaccgccaccatcgagcgcatcctccaggagcttcccccactcgggggcggcgcggaggcccgaggggcgacggcgggggctagcgcctgccagggggggctttatggcggcgtggccggagtggcgtatatgctctaccacgtctcgcagagcccgcttttcgccacggcccgggaacgctacctgcgctcggctaagcgcctcatcgacgcgtgcgcccgcgctgaggagtggggcgaaccggacgccgacacccgcgccgccttcctgctcgggggcgcgggcgtgtacgccgtggccacgctcgtataccacgccctgggccggtccgactacgtgcagccgctgggcaagttccgggctctgtgtgccgtctgcgcgccggtctccttcctggagtgcggctccgacgagctgttcgtgggccgcgcgggttacctgtgtgccgcgctggtgctcaagcagaaactcgcccaggaggtaagaggtagcccgggccgcgggagggcgctcgccgcctgcccggcctcctttccccggactccgtggctcgggcagcactgtcccgagttgctctccaagtctttgttactcttggtgtggtgctagcatttcttcagtcccttgaggtctatctcctgcttttgtccctcttctttcctgtcgttttcagtctctcatttgttgagattcggcgtctctgcgctttgttcgtgtttttacgtggcatcactccagatgcctgttagctttctgggggatgacagtgtggccctttcaagtaagatgaaaacctcagaaatggaagggatttcctttcctttgactctgctgtcaaaagctgaggcatcctcgaatgttagagtgctagaaagtaatggaacttttcggggccgatgtggaggtaagttgcttctggagccctgggtctgtaaccaagaataactgctcagctgtgggtctgatgtgtttactgttttgcttactattcagttcaacccatggctcttattaaatgcatatctgataggagtgtcccctttaaaaatacataaatgtagacggaaacgtacccggaaatgtaccccattgtggttgaatgtgcattatttcacttaaaaatatttgcttaggatgggcaagaccacagctttcttgacagggcagcttttcttgatgaataactttacagtggctcctaaaagtgaattggttttcacatacatattttttcctggactcactttgaaatcagcatgtggttattagaagagaatatgccagttcctgtggagtaggaaaaagaacaaaactctgaaggatcatagtgactagaacggagagagaggcactttcattcataatcccctggagccaactactgttctagggaggaagtgacacatttaacttggctttatttaggtgagaaaggcgtttgaagaaaaattaaaggtatatagagtgttttaaaagagtaattaacttagatcacctctacagaggcagacagggtttttttttaatagcaggtgaggttgattcaagtgagaaaaaagattactaaagaatgtgcactgtgttagctgggcagcaaaggtttatgtcacaaagttgtcttgaaatagtttgctctgcttctgagtcactgttaactgccagcagtttttcaaatgcccttccagttgtagaaaaccttttagaaggccacagagatatttacatatcatttgcattgcatttgcatctgctcccctcaccttgtagtctggcagcaggcaattttcaaatttttttttccaattgttttccttaatcttgcctcttcccctttccatgccttgaggccttttttccagaatggaatgggaagagtgtgtgaccactagatcacacaggtggaagcagaccagaaggactctgcccaaaaactggtggttcaggccattctgcaacactgatccacacaagacatctattaagacctctcttctgccctcctgccaaaccaggtctttttttttttttactaatcgagttgaggtgctttggcccctgctcccaggagatggaacaagcttcaaggatagcaaaaaaaaaaaaaaaaaaaaacccaccaccaccaccaacaaaaacaggtcttaacctgagcctgagcaaaccagttagttccagtgccagctgcagctgtgtcaattcaagactttctggcttgaaaggtgtagggcaggggctaagcatgccaggctggaagccctttgaggggaaagtagaagttttataccccatcccctccccgcaaatcctagccagcacaggactttgtcctcagtaggtgatccatagaccttgattagattgaattgcgaatttgtgtcatttctctataaataatctctcagtatgtcctgggtttcttcccctccgatgtcatttatattcacattcctctggcaattccctcagttatcgctctaatttagatcctccccacattactgggcacatctttgccacctaataaatagttgaatgaatgaatcaccatatattgggattagtgcaatatactttgagctagaatctcccactcaagccgttccatctacctctaagaaacaaatatttcaaaagacatttttcatcatgttatttccctgctcaacatactgcagtggctccctattactttttctccagtggcttgtcatctcacaaagttatgattcttaaaaatagccgagaaggccccacatgatctagcctcctacactcctactctactccttgctcattcttcttcaaccacactggccatcttcctgttttagttactttcctgtctcaggctgtttgttcttacagttctttctacttggaacactccctctagatatttatagctagatctctgaccttgtataggtgtgtgtgtgtgtgtgtgtgtgtatgtatatatatatatatataatttttttttgagacagagtctcactctgtcacccaggctggagtgcagtggtgcaaccatggctcactgtagcctcgacctcctgggctcaggcgatcctcctacctcagcctcccaagtaggtgacaccacaggcatgtgccaccacacccagctaattttttgtactttttgtagagacagagtttcaccacgttgcctatgctgttctggaactcctgggctcaagtgatctgcccgcctcagtctcctaaagtcctgggatgacagtcatgagccactgtgcctggccttgtataggtctttacttcctcaatgaggcttttcctgactaccctatttaaaattgcaaccccaccctcaacttatccccctttcgtgatttgttttacttaaattgtttatttatgtcttcgctgattagaatgtaagctccataagggtagacatttttggtttcattgatgttcattgccaagactgcctgacacatttttagatgcccagctttgtgtgtgtttgcaaatatcactcaattttagtggtgtcccatttatcaatattttcctttacggtggtagttttggtgtcatgtttaaagaaatcctttcctactgccaaagtttcagtaaatatttgttaaatgaatgaatgaatgaattatagtttcttccaattatttttcatggcttaagctcaaccaataaagcagtgcttcttaaactttaatgtgcttaggaatcacctgcagatcttgtagagctgcaagttcctgggtgatcctgatgttgcggtagagcatgctttgaatagcaaggcaatactgtgctgcataggttttggcattatacctgccacctctattaaggcatactatgagacgccattctatgaagcttgatatgtttatttaaaaggtctatagtttagaatgctgattactatattctacctttcactctaaagacccacaagaggaattgctctcagattgtagagacagtaatagttgtgtgactcctggcaattgattgaatttttaaaatcgtcaaaatatgtcatgtaactgattctatttctcactttgtgttggctactagggagtgtatggctagaattgtggtccatataagctagcgtacagtaccttagcagatctatatttatgtgtggacatttcccctgggtttatctaatttgtttcttccttagtttacccttttctaggttcttttctttttatttgattttgttgtttgtatttatgtttataaggttcagatataagaaaaagatgtatgtgtatgtggcaagagacagagaatccctctctccaggcatgtattttcacttaacttggccttcctggaatagttccaagggtttcttaggcagatatccttgagcaatggggcattgaagtctcaagaaatcatgccataaaaacttatattgggcccattcggctttccactgattggtggaaatgtagcagacaacggcagagggattctggggagacctaggatctcagttaaaataataattctgccactgagtgatcttggaaaaatattttaacatcgttgaggcttaatttcctcacctgtaaattgattaataagagcttcttcgttgacttgttctggttttcattcattcattcagtaaatgtcaggtttctacatggtgtgaggcaacttactagatgcttgggttcagtagtgaaccaaaaataaaagtctgttggtgaagaaaaaaataacatcagtctttttagataagtgctcttagggatgtaatcaggaactaactgaggacaggtggcaaaggggagggctgctgtttggtaggaaagcttctctgtggaggcagcgtcctggcttatcactagagcatgggaaccaagtggctgctctaagaacaggcattccaggcagagggcaagagcccctaaggtaggaaatgacttggacatttcaaagaaatagaaggaggctagcatggctggagcagagagagagcaggggatagaggagtttgaaaccatggaaggagacatgagcagggtaaaatcagatcctggaggcccaagttagtcaaagttaggagtctgcatttgtttcgtgtttaaaggaggaaatatcttgatctgacttaccttttaaaaagatcgccctggttttctgtattaagagtggattgacaatattaagaatgataacaagggggactggttatggggggtctaaaccccttttgtgccaaggactccttgtcagtctggtgaaacctacaggacctcgtcttagaataatatttttaaatgcataaaataaaacacacagaattacaaaggaagtcaattatattgcaaccatgttaccaaaacatttttaaaatgtgtgagcagtagcgtatgtgctcctttatcaacacattaaataagattttacagcaggctaaaggatgatgatacttttgaaacagtgatgagagtcaatgatattttgagataccttccacagctacagtgtggtatgcatctgtgatttctgtaggtgacaaagttacaagtacaactagtggtttgtagtttacatttgtaacgaaatgctaatttgtttaagtaagctaggaaacatgtagatgtgattttatttccccagccaaaggagactggtttggaagttgctgtgatgaccagtcctagataaagtacctagtacagtgcttggcacatagtagctgctaaatggaatcaatggtagcctttttcgctactactaacagaaaacctaaggtaattctgaatatcagatagaaaatgatacttaatatgacgtatctatcttcctgctgtgatttgaaaacaacaacaacaaattattgcaaagttgttaattgggtctttggctcatttctaaggcaggtggttggcagctgtataaggggcaatgcttttagctgtaaataacaaaatgcccaataaaaagtcatctaaataatgagaacatttattacctcacttagcaaggagtggaaaactaggccactccaggattgtttcagcaactcaggagagttatccaaatccaagctctttccaggcgttttctctgctattctcagtgtttgagctgtttcacctttcaatgttgtaagatggctgctgtcattgcaaacatagtgttcccctaactgaagtggtgagggaaggtctgaggctttttttccccctgcatctttttctaaagtcatgtagaacattctatcctggaagaatttccctctgactcattgcccagcacttggtcattagccagttctagtttcagggaggctgggaaggctagtgtttttatttttaaccttgatcattgacaggtaccgacacgaaaaaagggagaaggaaatggttgctggttggttaccaaagcatctgccatttggcgtcccttggcaaggtctgtcttgtgacctcctttatccattcgcttttcatctctttggtgtttcttttcccttttccaggtcacctccatgtgtcatgacacctgtaaggtatcttgtttttgctgtcagctagttgccaattaaataaaagctaagatattaactattaattaagatttaaactagcaaagtttggggaatatattttatggcagcaactgtgtttttcctaccttttcttaaaaattatttctctcatcaaagatataaaacaaaatgagtctttatttattaaaaatttgttttaggccaggcacggtggctcatgcctgtaatcccagcactttgggaggccgaggcgggcagatcacatgagatcaggagttcgagaccagcctggacaacatagtgaaaccctgtctcgactaaaaatacaaaaattagctgggcatggtggtaggtgcctgtaatcctagctactcaggaggctgaggtaggagaatcgcttgaacccgggaggcggaggttgcggtgagccgagattgcaccactacactccagcctgggcggcagagtgagactccatctctaaaaaaaaaaaaaaaaaaaaaaaattattttaaaagttaacatgttttttctttttttagaacagtctattccataaaatacctgtattttatccacttatacaaattatcatattatacatatattacacagcttgctttcttgcttaatgtacattggacatctttgcatattgtatagagagatgtaacatgtaacattctttatactggttccatttaatggttatactataacccttattgatggacatttgggttgattccagtttttctcctttttttgctatcacaaatagtgccataaataatatacatgcatatacatatacagtagtcccaccgtatctgccagggatatgttccaagaccgccagtggatgcctggaaccacggatagtactaaacgctatatatactacttttctgatctgatacctgagacacttactaagtgaccatggggcaggtggtttacagagtagatatgctggaaaaagggatgattcatgccccaggtgggaaggagaatgatgtccccaaattttatcatactactcaaaatggcatgaaatttaaaacttatgaattgtttatttctggaattttcctggtagtatttttggaccccggatgtctgctggtaactgaaaccacagaaagcaaaaccttggataaaagaggactgctgtaaaatgcatatatacatatataatgtatacatgtaatatatatgtgtgtatatgtatatatcttttcatatatgtatttttgcctacttttgcaagtatctatgtagggtaaatttttaaaacacaattgctgggtcaaagtttaccaatattttttatttgatagaggattatcaaattgccctccaaaaatgttctaccaatttctattgtctccatcagcatttgggagtgcctgtgttctcactgggtttcatcagagtttttaatatatgctaaactgacgagtataaaattaggatggaggtttccagggtagaaactgagtccctttattgtttctttcaacttttaccaaacaaaatgcatgtgtaggatttcattcagtctttggatttgagcggttcccatttttaaggcaggtgtgtgtttcatactgtgtaagtaaagcctgaagtttggcttgaaatggcagcagggttgggcaagctggatttttgtaggctgggttcaattcctaattgcctgattacagatctaccaggaagcaggcacttctatgggctatggcttagaccctttgttatgcatgacccagaacccagtgaatgataaaatgcagtgatgtaataaggactaacgatgactgatcacttatttccacacactgttgtaagtttttttcatgtattatgtcacttttcaaaatgtacctaagtgtaattttgtttgttaaaattttttatctttaattcacaatcattatatatatttatggagtataatgtaatgttttgatacatgtgtacattgtggaatgagcaaatcaggctaattaacatatccatcacctggcatacttatcatttctttgtggtgagaacatttaaaatccacttttagcaactttgaagtatagaatacattattattaactatagtcaccttgctgtgcagaagatcatcataacttattcctcctgtgtaactgaaactttgtacccttttaccaacttctcccctttccctccccatttccccccacccacctccagcttctggcaattaccattctactctcaccttctatgagtttgactttttgaggttctacatatatgtcacataatactaccaacaactttataacatgggcaacattattatctccatcatatccagtagggaaactgaggaacagagaggttgagaaacttgttccagatcacacagctagtcagtggcagagatggggttccatcttccccaggctggttgccaaatctgtgatttcaattggtgatcctcatattttaatgtgcatacaaaccccagggatcttgttaaaaatcagcttttagctcagtgagtctggagtgtggctcatgattctgcatctctactgagcttcaggtgatgccgctcttgctggtttatggagcaaacttgagcacaacactctgaattacaatttttttccccaattttatggggttgcctgtcaacaaatgtaactgctcctgcaaacttcatgattttcatcattttttcttgtactgaggatgacttcttccacaggtgcaagaataccagctctctggtttgtgggttatactgaaggaaagaatcacttcctgctgcatctccttgtaggtttaagggatatgttgacatctattgaatgaatgagcaaatgcatggatttctttttcctaatagatgtaatttttcactgtatacagcaagtttttcaaattcctttaaaggcccaaacaaatcacatcccagcaattttaaattatttcatggtaattcaagagacaccttattacatcattcccaaacagaaagcatgagcctgataatcatgataccaagcctattttagagtcattccactgattttacctgtttgacgtaaagtagtgcttctcctccaactctaaatcaatttaaacttaaaatgatcagacatcttcctttttattttctaatcacaatgatttaacagacctactcaaaataatttagaaagctttagatacagtctatttatgtcttttcatctgttaatatacattccacgaaaacccgaacttattatttgtattataatttttttattatactttaagttctagggtacatgtgcacactgtgcaggtttgttacatatgtatatacgtgccatgttggtgtgctgcacccattaactcgtcatttatattaggtatatctcctaatgctatccctcccccgtccccacatcccacaacaggccctggtgtgtgatgttccccttcctgtgtccaagtgttctcattgttcagttcccacctatgagtgagaacatacggtgtttggttttctgtccttgcgatagtttgctgagaatgatggtttccagcttcatccatgtccctacaaaggaaatgaactcatcctttttttatggctgcatagtattccatggtgtatatgtgccacattttcttaatccagtctatcattgatggacatttgggttggttccaagtctttgctattgtgaatagtgcggcaataaacatacgtgtgcatgtgtctttatagtagcatgacttacaatcctctgggtgtatacccggtaatgggatggctggatcaaatggtgtttctagttctagatccctgaggaatcgccacactgtcttccacaatggttgaacttgtttacagtcccaccaacagtgtaaaagtgttcctgtttccccacatgctctccagcacctgttgtttcctgactttttaatgatcgtcattctaactggtgtgagggggtgtctcatcatagttttgatttgcattcctctgatggccagtgatgatgagcattttttcatgtgtcttttggctgcataaatgtcttcttttgagaagtgtctgttcatatccttcacccacttgttgatggggttgtttgtttttttcttgtaaatttgtttgagttcttgtaaatttgtttgagtaaatttggttgagttcttgtagattctggatattagccctttgtcagatgagtagattgcaaaaattttctcttattctgtaggttgcctgttcactctgatggtagtttcttttgctgtgcagaagctcttcagtttaattagatcccatttgtcaattttgacttttgttgccattgcttttggtgttttagacatgaagtccttgcccatgcctatgtcctgaatggtattacctaggttttcttctagggtttttatggttttaggtctaacatttaagtctttaatccatcttgaattaatttttgtataaggtgtaaggaagggatccagtttcacctttctacatatggctagccagttttcccagcactatttgttaaatagggaatcctttccccatttcttgtttttgtcaggtttgtcaaagatcagatggttgtagatgtctggtattatttctgagggctctgttctgttccattgatcgatatctctgttttggtaccagtaccatgctgttttggttactgtagccttgtagtatagtttgaagtcaggtagcgtgatgcctccagctttgtccttttggcttaggattgacttggcaatgtgggctcttttttgattccatatgaactttaaagtagttttttccagttctgtgaagaaagtcattggtagcttgatggggatggcattgaatctataaattaccttgggcagtatagccattttcacgatattgattcttcctatccatgagcatggaatgttcttccatttctttgtatcctcttttatttcattgagcagtggtttgtagttctccttgaagaggtccttcacatcccttgtaagttggactcctaggtattttattctctttgaagcaattgtgaatgggagttcactcatgatttggctctctgtttgtctatcattggtgtagaagaatgcttctgatttttgcacattgattttgtatcctgagactttgctcaagttgcttatcagcttaaagagattttgggctgagacaatggggttttctagatatacaatcatgtcatctgcaagcagggacaatttgacttcctcttttcctaattgaataccttttatttctttctcctgcctgattgccctggccagaacttccaatactgtgttgaataggtgtggtgagagagggcatccctgtcttgtgccagttttcaaagggaatgcttccagtttttgcccattcagtatgatattggctgtgtgtttgtcatagatagctcttattattttgagatacgtcccatcaatacctaatttactgagagtttttaacatgaagggctgtttaattttgtcaaaggtcttttctgcatctgttgagataatcgtgtggtttttgtctttggttctgtttatatgctggattacgtttattgatttgcatatgttgaaccagccttgcatcccagggatgaagcccacttgatcatggtggataagctttttgatgtgctgctggattcggtttgccagcatttttttgaggatttttgcctcgatgttcatcagggatattggtctaaaattctcttttcttgttttgtttttgccaggctttggtgtcaggatgatgctcgcctcataaaatgagttagggaggattccctctttttctattgattggaatagtttcagaaggaatggtaccagctcctccttgtacctctggtagaattcggctgtgaatccatctggtcctggacttttttttgttggtaagctattaattattgcctcaatttcagagcctgttattggtctattcagagattcaacttcttcctggtttattgttgggagggtgtatgtgtcgaggaatttatccatttcttctaggttttcaagtttatttgcgtagaggtgtttatagtattctctgatggtagtttgtatttctgtgggatcggtggtgatatcccctttatcattttttattgtatctatctgattcttctattagtcttgctagcggtctatcaattttgttgatcttttcagctcctggattcattaattttttgaagggttttttgtttctctatctccttcagttctgctctgatcttagttatttcttgccttctgctagtttttgagtgtgtttcctcttgcttctctagttcttttaattgtgatgttagggtgtcaattttagatctttcctgctttctcttgtgggcatttagtcctataaatttccctctacacactgctttaaatgtgtcccagagattctggtatgttgtgtctttgttctcattggtttcagagaacatctttatttctccctcatttcgttatgtacccagtagtcattcaggagcagattgttcagtttccatgtggttgagtggttttgagtgagtttcttaatcctgagttctagtttgattgcactgtggtctgagagacagtttgttataatttctgttcttttacatttgctgaggagtgctttacttccaactatgtggtcaattttggcataggtgtggtatggtgctgaaaagaatgtctattctgttgatttggggtggagagttctgtagatgtctattaggtctgcttggtgcagagctgagttcaattcctgggtatccttgttaactttctgtctcattgatctgtctaatgttgacagtggggtgttaaattctcccattattattgtgtgggagtctaagtgtctttctaggtctctaaggacttgctttatgaatctgggtgctcctgtattgggtgcatatacatttaggatagttagctcttcttgttgaattgatccctttactattatgtaatgcctttctttgtctcttttgatcttcgttggtttaaagtctgttttatcagagactaggaatgcaacccctgcctttttttgttttccatttgcttggtagatctccctccatccctttattttgagcctatgtgtgtctctgcatgtgagatgggtttcctgaatacagcacagtgatgggtcttgactctgtatccaatttgccggtctgtgtctttgaattggagcatttagcccatttacatttaaggttaatattgttatgtgtgaatttgatcctgtcattatgatgttagctgtttattttgctcattagttgatgcagtttcttcctagccttgatggtctttacaatttggcatgtttttacagtggctggtaccggttgttcctttccatgttgagtgcttccttcaggagctcttttagggcaggcctggtggtgacaaaatctctcagcatttgcttgtctgtaaaggattttatttctccttcacttatgaagcttagtttggctggataggaaattctcggttgaaaattcttttctttaagaatgttgaatattggcccccactctcttctggcttgtagagtttctgccgagagatccactgtgagtttgatgggcttccctttgtgggtaacccgacctttttctctggctacccttaacgttttttccttcatttcaactttggtgaatctgaccgttatgtgtcttggagttgctgttcttgaggagtatctttgtgacgttctctgcatttcctgaatttgaatgttggcctgccttgctaggttggggaagttctcctggataatatcctgcagagtgttttccagcttggttccattctccccatcactttcaggtacactaatcagacgtacatttggtcttttcacatagtcccatatttcttggaggctttgttcgtttctttttattcttttttctctaaacttctcttctcgctttattgcattcatttcatcttccatcactgataccctttcttcccgttgatcaaattggctactgaagcttgtgcattcgtcacgtagttctcgtgccatggttttcagctccatcaggtcatttaaggacctctctacactagttgttctagttagccattcatctaatcttctttcaaggttttaaacttctttgcgatgggttcaaacttccccctttagctcggagaagtttgatcgtctgaagccttcttctctcaactcatcaaagtcattctctgtccagctttattccgttgctggtgaggagctgcattcctttggaggaggagaggcgctcgatttttagaattttcaggttttctgctctggtttttccccatctctgtggttttatctacctttggtctttgatgatggtgatgtacagatggggttttggtgtggatgtactttcagtttgttagttttccttctaacagtcaggaccctcagcttcatgtctgttggagtttgctggaggtccactccagacgctatttgcctgggtatcagcagcagaggctgcagaacagcgaatattgctgaacagcaaatgttgctgcctgattgttcctctggaggtttcatctcagaggggtacccggctgtgtgaggtgtcagtctacccctactagggggtgcctcccagttagcctactcaggggtcagggacccacttgaggaggcagtctgtccgttctcagatttcaaattccatgctgggagaaccactactctcttcaaagctgtcagacagggacatttaagtctgcaggggtttctgctgccttttgttcggctatgccctgcccccagtggtggagtctacagaggcaggcaggcctccttgagctgcggtgggctccacccagtttgagcttcctggccactttgtttacctcctcaagccttagcaatggcgggcgcccctcccccagccttgctgctgccgtgcagttcgatctcagactgctgtgctagcaaggatcgaggctccgtgggcgtggggccctccaagccaggcatgggatataatctcctggtgtgccgtttgctaagacccttggaaaagtgcagtattagggtgggagtgacccggttttccaggtgccatctgtcacagctttgcttggctaggaaagggaattccatgaccctttgtgcttcccgggtgaggggatgcctcaccctgctttggctcacacttggtgcactgcaccctctgtcctgcacccactttctgacaagccccagtgaaatggacccagtaccttagttggaaatgcagaaatcacccatcttctgcatctctcacgctgggagctgtagactggagctgttcctatttggccatcttggaaccacatctgtattataattatttaaagagaacatagttcgtagttttttgttacagagtaaatggaaaaataaacacagtaaaacttgttttaaatgaacttaattatttattttgccaataactaaactcagtgctctgtaaggagattgttttaatggaattttattaaatgtattggcctttgaatgtgaaaatgatagattatattaatttcttactaacttcttcactaattacacttttgctggttaatttagtaaatgatgtttgtcatgtgattggctgcaacacaatatacaatggatttcctccaagtgacagggcggtcctgtagtgtccccacatggtaatggtctctaggtaaactggttcaacagttcgtgatgtgtccaagtctttctcttcatgattcaactttacaagttcatctctgaccaccagtcaagtaccatgtcttgactggtttgtctcataaaaaaacaagttgttttcattatacacacacacgcacacagatatatgtatgcatgtgtatataagatacacatgcacacatcactaaactcttcctaattattttctttatggttttagttactagggaaacctaccaagataacaggcccattattcttggggtgctagccacttgatcaaactgaattttcaagaagtatttgatctttctttttgcaagctgaataaaggagtgttttgtgtaagatcagattttcttttctgaatagctttaaccattcaatgaaccaaagaaatgaatgactttggcctgttaaagtgtgagtatggctatctgggtcataaagaagcggtttttcagatgagagacaaagtcttacagacttcattggtaagaacatctaaatgagaggtggcaaaacaaatattggttatggcattatgcgcagttagctgttactgtgcccatctgctggctccattgctttgcatggaatggattccccgtgctcagtggtgtgttgaaatctggtgtctatggcaacaaaagcatcaccaatctcaaagcaagcactgttggtaccagctgaatctccactcacacaacgactttaggaaggagacacagtctgacagactttatggctatctaaggccaaagagatccagtgtctaaccagaaacaatatattgtccttatgcatatatcattaacataatcttgctttttaaaatgttttttttttcttctgagacaaaaagaattgcacatttattacaaattgcaattgttgaaatagtctggactctcaatgaagacattaaagcatgatggttaagaacagccttttcagattcaggtagccttgggattgtcagactccactgcaatatctgattgactttaagcaagttatttagcatctctgaggcttaatttcttcaccaacaaaatgcaattcaagcagcacctacctcataggtgtgctaggaagggccactgagaatgtgtggtaacatgcttggcagaggatgctcccaggcatagactacgaattccctctgtcagccatgattttgagtattggtgggcttcagcatagggtgatgagacagtgtaactgcatttacactgggatggagtactccaccaaatgtcagtatctgtgattcttttttcttgaatctatctgacaactataaaccctccttcaacctactacttggtgaagacagtggctgccagtgttctggatattgattctgagtattggtgtgctttagcgtagggtgctaaagcagtctacattgactaaatagcatatgtattcttttggatgttcagccaatctgtcttatattccctgtggtggcattcagagctgctatgtcctggatggcaacagcaaagctttgagattttcacacagaggccttaaagggctggagggaagccctctgctctgccatgcaggagattaagctgagctgctcaggcagattatatgtcaaagtaaattgagtgggcatcacccctaaaacaagaacttgtgtgaattactctgcacttcctccagggaaaggactcttttctcttttaaaaactgtaggatctttgcagtgttataagaattggctttcttgtctctgatttgtgcttcttggagtaaatcacctgattggcttgaagatactgtaaattgccatataggtgatgttggaatatttgcttcttgctctgttccccactccaaccccctattctgagtggtggattcaataagctattttttgctcttaagttctcgtctttgtttctagagataatttgcttacatagcactaattcagattttcagaggaatttcaatagttgtgacactgtcaaagtgacaacttcaaatgagttttcctcagcaaatgttccaggtcatgtacatttattagcttgtttcagaaaacggttaatacagttaaggattctttcaagtgtttcttcagctactgggctcagaaattatttttttcttgcattaatagactcctctattagtatttgaaagctgtgtgatataaagctatgtgactcactgtcagttttacaaacttaaatctgcacttcactctttcattcctagctcctatttatattcatttatcacataatgcttttgatgttaacaactacactactctaataataaagctataattatgactttcccctatccctaatcggggctgggggtgtcatgtgtattgattagctctgcttatgatcttcagtaccacaccaactgggttctaagtcttggctttaatctccatgtgggtctgttatttttttttctgacacaagagtttcttacacgtgaacatgcattagaatcccttgagggcttgttaaaacacacatcgctgggctccactccctaaatttctggagatgggcctcagaattttcacttttaacaagttcccagtgatactgctactgctgctgctggtctggggaatacatttcgagaacgaatttcttagactgtacccttaaccttggccaaacatctctgaaatgtgggaactaggtgagggcatatggcagcagtaccataaacttatcaccactggaaaataaatcaaaagataagacttactgtgtgacaggcactaagataagcatattttcttcattttacaggtgagacaattgtgacttagagaggtttagtaacttgcctatcatcacacagctagtaaagtagtagaacccacgtttgtctgactatataacttcttaatttctatagatttaagtcaggtaatctgtctgcatgtttttctactaaagcacaaggatcttgggcttgcaccccaagatgtttggaagaatagcctgaactcaactcaacactagaaagattcaggaattagaggttctaggcatctctggtgttagtggtggtgtgggtcatgtatgaaaacagaattagttgcaagtttgataaacagtggttagactcccagatactttcccaaatctgagcaaccagatgatggtcttaggccagatttcccaaagatgaccgtgagatgtggattaatatggaattgttgattaaggaagtgttccaaggagaaaccagtataagaatggggaaagtaggaagcagtgaatggaaggaaatgaagcaagagtgtgatcttaggctaaattccagcctctgtctcatcttgtagggaagctctagagtgtatattacactctaggctagaggtacactgttgtaccagtaatgagctccagctggtggtggggggggtatgtacattttcaggtactacagactctcttggcatgctgctgaagttgtacttgtagcccaaagtagggctctaaagaagcctgcaggtgagagttgttagaagcaaagcatatggacatagggggatggactcaaagagctgataaagaagcatctgagaaggtttgatagggaaacctgcagttcctccacctgggccctccacaccttagtagaagccctgagattcacttttttgacagattgaattaaagaaactcagctttgaggcccaaggcacagtccagggcacagtcagtggtacttcactgaaagcagaatgacctgaaagtttacatgctgaattgtgggcgcctccctcctgcacacacatttagttaacctcttcctgaaatccacatccagaacattggcagccactgcctccaacaagcagtaggttgaaggacgatatgtggttatcagatacattcacaaaaaaagaaccacagatacagacatttggaggagtacttcatcccagtgtaaatgcaggtacactgtctcatcacgctgtgctaaagcccgccaactggctagccctttcccatacccagaattgccagtgaactttttaggatgaaactgttaaataggaacggtcattcaaaagacatttgaggaacatgtctgatttaaaaggcagtgatggtaacaaaatatacaaataggaaaacaatcttggaggaaacagataatactgcataagaaaatttcccaaatgcccaaatctataattaatattgtcagagaagaaagtaatcacatgtctgaaatgaaagcaggatattattgaaaggactgttgagagaacagaaaagaactcttagaaataaaaaaaagatagcagaaataaaaataattcagtgcaaaaattagaatattaagttgaataaatgtccctgaaagttcagccaaaagacaatgagattgataataagagaaaagattaattagaaatgtctaacctctgtctagtggtcggtcccaattaaaagaacaaagtgaaagaggaaaattatgaaaaaaagcaagaatattttttataagtgaaatacatgagttgccagatttaagagacccaccagcatattggatgggaaaacaataaagaagagtctctaaaaatttccaaaaaggaagaaacctggtttcatacaaggattagcattggacttttcatagcaatttagaaatttaaaagacaatgaagcaaggtctccaaaattcatagagaaaattcttaactagaattctatagcagccaaaattatcaatcaagtgtgaaagtagaaaacatatctttagctatgcaaggtctccaaaaagataccctttttgtagtttgtcaaaaagagggaatgaaccaaaacattggaaaatatgggatcacaaaacctgaggccccaataccagtggggccacagggaacttccagggtggtcttaaaaggacagtccaggatcacggctgagtattaataccaaagggagaaaaaggagacaaaagtaggactaattgcacatgatattgctcaatgaatattgatttagccaaataatgtgatactattattttgggtaggtaagaaaggagaagtatgtatggagagatcataaaaaagctaaagtttcatattccatgttaacagattaatatataatgcctaaatgaacaaataaagaaatagttgtataaggatgtcatttttaaaatatggagataagttgctaaaaaaatacacagataaaagtgttttaattttttgcctcaaaggagttgatatatggctgggaataggtgggggcaggagtctgctattattttgaagagctcttgacttttaaaacaatgaacatgtatttctttgagaaatataaacatcaagaaaataaatgagggctccttagctgactttacctgtgctttttggccattatttatacacagtttgttttgttcttcacatttacccccttcctgctcaatgattaaacagcgttgttggagaacatttatggaatgccatctaataacagaaatgatgtggtcatttatagataaattttgtcagcaaacatttccccatcaaaaatatagcttaatatatccattatatccttataagccatagtaaattaagatttaatgatgatgttttattagtagaataaagagttgaatagctctgtgttgattcaaatcttcctatggctttatttacacagttgtgccttccgtagtaaagtattgagttaaaaatgagtactggacctatattaagcttctacccagtgagaaggggtatggggatagggcccagttaaaataatgaaaagtgaaaagatagatgattagaatacaataactggttgaaccatttatctaaagcagagcaagaataacagtttttcatggcagtgactctaagatactccaagtttttaaaatgctttcaagtcattgcaaccaagataaactgataattatatagaacactaagttgctaagtgctttttacataagctgtcctatttaattcttgcaatatctcctcaagttggatattattaccacattcattttcagaatagaaaatagaaaacattgcagagaggttaagtagctttccaaaggttatatggttgagaagtaggataatgataacatttattgcccaagcaggatacttttgacaggcatcaaccagtggggaatctaacaacagatacaacccaagatttacctatgggacttatggcccccaattgataagagatggagcctagtccagaactcaaattcttctccaaagttgtgaactttctgctgccttgggctggtagtatcattaatgttaaacgaaattccccattagctaattataccaataaatgttgactgaatggcaattgtttttgtttgttgagagaactttcatgggaatgggcaaagcttctaaaccagtcttggggattcaggactgaattagttgcttactctcaccctagactcaccaaagtagattgaaatcttgtagagggaaggtgtctgggggtcattcaagtacaggttagaagtcctgaatagaacataataaaaggactggtagtgcaatgctggagacaagcatgtatggttaagtacgtggagcgaaattagatggcaagttgtgcaataaaccacaaagcaaaaagtttctaacaaatttgttccctgagtttcttctgctatttttctcacaagccatttttataatgttcttgctcccttttccctggcatttctggctgcccttttgggtgtattgctcactggacgtacagaatcacttttgttttcatcttacatgtttcctagggagccttcagctgaggcaactccaagctcttaattgccactgcctttttactactacagagcagaatgataggcaccttcctggcaaacagaatatgctcaatacatatttgcagaaggaaggaaggaatacagatgacgtgtttttaattttatgaaaccaaataaccccctttgaggctcaagtataaaaatctaaagaaatggcaacctacattttaaaactagctgtttacatgctcctgcttaaatgtgttttcacttttatgggtctgacagcagagccacttaggattaagtatttgatggacaggattcttagttggtcatgaatattgtcacattttcacatacaatctgccttttgacagccaaaagatggcaaaattctaccacttgtatattataaaatgggaagtatccctagcttgtgacagatccaaatgatccacttacgcgtttctgtgctgacaagtagaactctctgattgtaaacatcttttaggaaactgtaattttgtcctagtacaatacctgacatctaaaaaggcttttgtttggcttttaaaaataatcatcattacttttatattcatgcaggtgataaaatttcatatatatttctggacccttatctccttatgtttaaagcttgcattcactcttgataaattgaacattgactagctatgcactttacagctattagaatttctctttttgtctgtttcttttgaagggcttgcacttttcctgtaaagaagaatggagagtaatatagaaaattgtcactttaattttatattaatgtgttgttccccaaatagctgttaaattcaatgttcatgaattatatatgtatggaagagtcaaagcttatttccagtaagtttacttttaccacagctaagaaatgaatatctaatcatatccttctcctagtgaataaagacacctgaagaaataattacatcagaagttggaaggaaaaatgggtcctcgtaatttttctgaagcatactatgacttaatataatatttctccatcttagatagcatgagcttttaattagcaaggtggcaccctgtatggaacaactgtttctgagttgtgctgttgataattgaacaaagataactccctatcagtatctccagcagtcagagaaaaatctccaattcttccctttagcgcaagtgacttcttagaggttctactaaaattgttgtgtcaaatggcttttaacattttgcttttgagcttaagggattttatgtttttcatcaggcaagctgtgttcctgtcctgatgaaccaaatgcgaatcaaaggcagaacaatcttattgtgatttctgttactgtgtagcgttttttaaaagagatttcaggccaaaggtagtactttctcagaattctgaagctgtgttctctggcagttacgattctgtcatactttcagtatgttcacagtgtcttctgatttttgattgccaggaattcctttgtcttttgctttcttaagtttcatttggtgtgtcttgtgtatatttcatttaaaatatcctacttgttatatgttgtgcttcttgtagttgtggattcacatctttagtgacttctagaaaattcacagctgttgtcccttcaaatattgcctcttctccatttaacagctacattgagatataacttatatatcatacaattcacccgtttaaaatatacagttcaatggttttaatatgttcatggggttgtacaaccattaccacagtcaattttagattttccttacctcaaaaagaaaccttgaagccattaacagtcactcctctattcctctcaaccccatcccacactcctgctgacctaggtacccctaatttagtttttttctctatggattcgcctattctgggcatttaatacaaatggaataatataatatatggtctttggtgactggcttctttcactaagcaaaatgtctttaaggtctatgcatattgtagcatgtattagtactccattcctttttattgccaaataatattcctttgtatgaatgcatcatattttacccatttgtcagttaatggacattggagttatttccagttattggctgttatgaataatgctgccataatgctgttttgaataatcctgatcatttgtgtacaggtttttatgtggacataagtttttatttctgttgggtatataactaggaatggaattgctggatcatagggcaactgtacatttagcattttcaaaaactgttagagtgttttctacagcagctgcaccattttacatccccaccagcaaggcacgaagggttcagtttctccataccctcaccaacagttaattatttgtttagagacaaggtctgcctctgtcaccaaggctgggggtgcagtggggtgatcatagctcactgcgagtttgaactcctgggcccaagtgacccttccacctcagtctccctagtagctggaactacaggcacacgccaccttttttttttttttttttttttttttttgtagaggcagggttctcgctatattgcccaagctgttctcgaacttctgggctcaagccatctttcagcctcagccttccaaagagctgggattacaggtgtgagctgccaagcctggccacagcacttattattatcagacattttaattatagttatgttcattgggtatgaagtgtggtatctgataatcattttgatatgcagtttcctgatgacgaatgatattgaccatcttttcatgtgcttattggccatttgcacatctttggagaaatgtctactcagatactttgtccatttttaattgagctattattatttttatttagttgtaagagttctttatatattctggatatgagtcccttatcagaaatatgatttgcaaatattttctgccaacctacaaaagtaggttgtcttttaactgtgttgatggtttcctctgaagcacaagttcttaatttttataaagtccagtttatcaactttatcttttgttgctcatatttttggtatcatatctaagaagactttgtctaaattgaattcatgatcttctccattgtttgtatcaatgctttgctaccttggctgcccattaggatcacctggggagttttaaaaattcctgagtccaggccatgctccagacaaattaaatctgaatctcctgggccaggtcctaggcatcaataattttaaagttcttcaggtaattccagtgtgcaaccgaggtagagcactctgatatgcagtatctagtcaattatagtaatctgtcttttgtaagatgcatttttatgtaccagtaagaaagagaaaaatcactgtcaatcaaaatgacacaacaccttcttatcacttaggattttatacttattgaaggacaagtataacttatcttttaaagttatttagacattgattttatcatgtatcactcatgtgtatacctaacagaaaaatataagcaagatacgttcattaagatattcataaaactttcttacagtcggacttctacagtcctgaatcacttcttcctcagtcactgatttccgtgatttttcacaaagtaccttcctttgtaccatcaaaagcagtagtgatgcagaatttcttaaaagagtgttccactttgtctgtggcattttttcccaagtagttgacacctagtttgaaggttttgatgcacatgcacagaccacgagagtcacgtcctactgcctcctggccgatggtgattttgacatatattccaatttcaaagatgttaagatttttttaaaaaagtatatcttggaattgataaaattatgtagtttttttataataggaaaagggacttcgaagtatctagactagtgctactcaaagtatggcttgcaggtcagtgccattctgcaaatttgttactagtctacacgatgtaagtatagaaatttgaggtaagcacttaggaactttatgaacaattagactgagtaattagagtgagttttctccggtaatttctctggtgatgtatcagtatgttattttgtgaaaatatcagtccattatggattagacatttaaataaaaacaagactatttcttcaccaatgatagtttgaatactattgatcctagtggttctgaaattttagtgttcatcagagtcacttgacccagactgataaagcacaagttgttagccttacatagatctggggtagggtgggataatttgcatttctaacaagttgctaggtgatgccagtgctgctgatccaagtaccacactttgagaaccactgtcctagaccactataatgctggcagcagaaattttgccaacggtttccagcttaatttgtagaacacaaagtcctgatgctctcttggaaagtttcagcttccagtgatcactcttagtgaagttagaataacttctttaaaactcagtttaatctcctctccttggtgcactgttcagagcaccacaacatacagtggcataatcactgtaggctgcagagtatatgtgatcatgtttggttagatgttcacagtcttcttagaagagcaaaacatgaattttatttttcaagtgaattggtgctatgatgggtataattaagctcccagttctgagaattctgtgggcactctgttgacagcattctagagactggctgctcaagtagcacaaatatccaaggtaaccctttccagtggcataaaccaggcagcctgccagacttctgagatatttgtattggctcatcgaggtgacaggaagaagtttgtttataaaaaatcggcattgtgtatccatgacatgcttcccagaaacaaatattgttatcattgtcatcttaaagaataaagtagcccccccttatcctcagtttcactttctgtggtttcaggtgcctttggtcaaccacagtctgaaaataggtgagtatagtacaataagatattgagagagagagggagaccacattcacataacttttattacagtatattattttaattgttctattttattattagttatttttgttaatctcatactatgacaaatttataaattaaactttattgtaggtagttatgcataggaaaaataacagtatacatggggttcggtagtacttgaggtttcaggcatccactggggatcttagaatgtatcccctatggataaggatggactagaatatatatcaacctcagagaccttaataaatgacccattagggaaaaattaatatcattggatgagtcaaatatattaattattggtgccacaggcagagtaaccttccttcttgccaccatggcaaatgctgctaatcttttcagtgtccacaggcaacatctgtagccctctgaatattagatgatgcatgcctttcactgggatgggaataattaacaccctggtattgtaacctgctatgaaccttattagagtactaattcagtacttctcaaactttcatgcacctgaatcacttggagaacttgttagggggctgggatggggcctgagattctgcatttcttttaagctcctagttgatatctgtgttcctggtctgaggaccaagtgttaagtgacaggatgcgaaacacttttgaacccctgcttttgtaaggtcgcctgtctgacaaactagcaagtgggacagtggtataaccctttaccagaagcttagcccactcacccaaagtggtcattgcctgtgtctctactcagtaaaaacattcagctgacactagggatactattcgtgttggaaaccactccttttatgtctatatactttaagatatttttaccttgggcatgaaaaatgtcaaatttatttccatcagaaaatgctgtttggtgggggaagagttgtcatgagtagcatattgtgggtaattgcatagcataatatcagagaaaagcccccaaatactaaggaaagataaaagatgcagcctctgtgatatgccacttaatgatgtcctcagaaagccacagctttcccttgtaaatttcaacttatgatcaatgatcagttgtgcatgggatgagtactgctttaataaaatgataatttcattgcttcctttggtcttgggtgaaactcgagtgacgagatattattgagtctgtgtgcagtcatggctcattgtggatacttagcatgcttctattctcaaggagcacattacagtaaactaacaagaattattttaaataatgaaatctacccagatctgagggcaaatgctagattcctttcctggataaatgtcagttagcaatgcttttagctgcaaatgatagaaaatatgacttacagtgccttaaaatagggttatttttctaatacataaaaaagtctggaagttggtggctgctagcaaatgagttcaatgagttggtgatgtcaaggccagtgtctctggacttcattgccttttttgccttatggttgcagataatgtgtggaagctccagataccatgtctatgttcaaggcaggaagaagagtgaagtctgtaccagatatgtctgaacttatcagggaaacgaaagctatccaataaatctccagcaaatttctttttatgtctattgagcagaactgttacatggccatgtaagggaatctggaaagcttgcatttatctggcctaccttgaaaaatattggggtcctattagcaagaaagaagggagagattgctactgggtaggcaacaaactggtgccatgccaaaagtagctagaagtaaaatttccccgcctgatgtgattaaacttcgttcttagcagaatgcaatgatcatttctaggaaaaagagtgagtgtattggggcaggttgggagttttggtagagagaagaagcaaaggtcaaacagtattttgacatccaaactccactccctcccagtgagaaattatacatatatatatagttttgaagtaacaaactatacctgaattcaaaaggaaaggcaaacagacatcatgttatgcatgcaaagcagtttgcaaattcaacaacagaatttctaaagtcataattatggcagctccccttattctgcagtctttttagaaagttcaagtattaaacagcttgtgttgtcagcttaatgaatctctaatgattttgaaagaaaactctgtaccattaattatcattagaatgcctcttgggacacttcaagattccatttttgataagaagcaacccataaggtcttttcctaaagaatgaagcagcgtaaaacatgaacatcttggggtatagttctttaaaaaattttctttagacattgattatttgaataataaatatttctctaatgatgttagtatatatttgtttttgattttttagtcaatgttctgcatgagctaaagttaattagatttgattggagtaggattttatacatagatgagcctgggtaactgtttttgtcccctttttcatttaatcttattaaaataatttaatcactaggaggtaactcttcttttgaaattgaggaaaaatgcaattttggttggaggggtgattttttttctcttaattaaaaacagcatgtacagtcaaaatcagtcttttcaacttggttttgtaacattttgaaggtgattgccttgtttaatcctttctctgtgctttctgtttctgaattagctcatacagtttttatctgtagtctagtcaccggataaaaaggaatgatttctgtgttgtgtagattttagaatttggggagaaaagtgagataaaagacaaactttaatttagtttcactgatctaaaggaaatagaagtgttttacagattcctataggaagtctggcagggaatgtcaattgtgaaaagatataggtgggccattttcgatagatcttgaatcaagagattagttcttactagagaatcactttcctgcttccaaaagaaaatgtgaaataacttgtgccaggatctaaaagatgagcagggtcctagtgggacaatgtggtagagatatcagaaactagattttccaggagttttatgcatgcctcagagtgaatgagctgaattgacagactaggggagatgtgaacattgaagtggagtgctgtattctaacttcccattggttccactgcccctttgttgacatatttgtaagtactactccctcttttgtgtctgtacagaagttggcactttgggtcctgagcactgccagtgctgagagttctttgagagcagacccgaaacctcaaacccgaaagggtaaggagtatatcccgtcttgttttccaccatacttggtgttcaatgaattgatgaatgaatgaagaaccccactgtggttcttagacttgtgtttgtatctcattttaagatctacattctcattggcaaatcatgcctacattccactgtactttagtcaacttgtattgagagactacttggtgtgactttgaaaaattattgaaatatcttgaacttttcttttcagagcacaatgattagtggggataccttgtgcagaagaaaagggaaaaaaggtggcggggatagggaaaaagaaagaagtgttgaagttgataggcatgagcacattcaggtttaaattaactttacaagttgctgcttaagaaatatacctaaaaaatgggcagctctgctattattgggagacgaaaatattatctcacctctacaaaatgaggctgcaatattgaaacaatgccagcttccctgctgggcagcctgccgacatttcacttaggcactgaattctttctcagctactctggcatctgtgcccttcctgctgttccccactttgccaaaggctcagcctccctgagccatgtgagaatctgccctttgttgtacttgagcagagaatgttcccaacatttcatttgctcttctcctggtgagctggagaggaagagagaagcagtgtgacaactgttgtactctcaagccaaaatgtcagagctgttctgaagctaagcaccccatctttgaagtcattggcctccctccaagtctttctggctttgaaatggcagtcagatctgcatttgtcctatgaggtgctgtaagaggttctgcagtggttttagatttggagctcttgttatgagtcatctggagaactttttcagagatattccaccttgggcacatgtgtcagttattactggtgcgtaacaaacgacctcaaaactgagtggcttaggttttgttttattattattgttcgtatgtctataggtcacctgatagttctgctgagctgggtcaggcttggcttatttgggttgggtttgcacatgtgtctgcagttaggtgaaaagtcagctaacactggctggcctggcacaggctcacttatacgtttttcagctagccagctattgactggtgtgacaggggtggctcaaaatcaagagcagggatggaagcatgcaaagcctcttaagtttggaagtgttgcaccgtcacttctgcagcatttggttgaacaaagcaagtcatgcagccagttcgaacaaagcaagtcatgtagccagttcagttgtgaagggtagacaactggattccactttttgatggaaggagctacaaagtaaaatagcaaaagtcattgatgcagagagggaaagactttgtggcaggctttgcaatttttcacagcatgtggtctcagaggcagcatgaaatgagagatgcattgagatgtgtggatgtgtgttcttggtttctacatttctgtgaagtgtgagatgtgtgtgctggagaaggggaggggcagatgctgaggagtatttcacacccctctatcccctttgtcgccatcatctttcattagggctgccacaaataatcccagacagctttcttcacaggtatcatgggccatttatccttacgcctccgaagggccaatgttaggtattaaactgcagattgaggccacagtggatgtggtattattcagttatgtgcttttgctatttgttgttcttttgaaaagcaaaaaaaagatgggatagtgattatgcaaccccattattaagctattatattgttgcttttgatgtagttcccaccttaagactgaaatacaatgactcaacttctgagatttccttcttagaccaatgcaagtatacagcccacttaacaacaatgaaggtcagtggtgcacatcttcggtatattcatctcatccctgactccattttagttatcctactcttattttgatttcttattatcctcatgatggcctacaggaccctaaaagatgagcaacagcccttcctggcattacctccctgacctcatgtcctacctgtgtcccctaggcttctactgcttcatacacacaggcctccttactgttcctgaaacacaggtacactccccacttagggcctttgcatgagctgtgccctctgcctagaaagcatcacctggctgacatgctcacctccttcaggtattcaatacaatgacacctttttgacgagacctacatggaccctcttatttaatacaacacactgccacgctctcaccaaaacatctcagtcctcctcccctgctctgcattttctttttttctgaacactgatcaccttctagtatactagacagcttgttcatttataatataaattttgtattgtctgaacctcctcttcctgtgttttggagatccccaagaccaccccaggatcagtgagtcactgggagaactcaaaggactcatatggttatagccacagttatggtttattacagtggaagaacacaaagcaatatcagcaaagggagaattgaatggattgaaatactggggaaaccagcgcaggcttccaagggtcctctcccagtggactcacataggatgcacttaattcccctaccaatgggttataacaatatacatgaaatgttgtctaccagagcattctattagagactcagtatccaaggtttttattggggggtggtaacataggcaccccctgcccaaaacatatcaaaattccagactcccagaaggaaattaggtgttcagcataagtcacattgtttgcacaatttagatgcagtgagccagtcttaccagtcctgggaatggtcgtcccaaaattcaagttcccaaatgccagccaaggaccaaccttgcaagcaggcctttttaagaatagcattcccagtgctgctatgttaacacatttctctacaccatgcaggaatatcagctctttgaggacagaaatcttttgttttgttccatgatgcatcccctaaaaccagtgcctggtaggtgtgcagtaagtatttgttgaatgaatagatggaacccagacccttgagttaactgtctctatagcagaaataccacacaaaggaggaacaaactcctgatttacccccacgaggctttacctgaaccagcagtcccacgtacgtgtactcctacccagatgtctccgtgtccaaggagcctgaaacgagctcagcttccacgccctaatctgatcctgattatttcacatgtaagtctatctattcaacagtgtttcaaacacttttgatggaattatgcagcatacaagctggaaaaaattcttctcccttaagagcccatttgcttagatgcaacatgttcagaataacctagttagttgcttagtgagggtctagtcctcttcatctattttttgtcttcaccacatttgtcttttgccatccacagtgcctagcactgtgctaaataaatgcaacattgcctttaaacatttctttggactgaaaactggcttggggggatcatttgactttaccagtggctggttttgacatttatgtcagcaatttcgcagtttcttcttctaatgtttatttttaaaggcaaaagtgccaagttaaatgattcccctctcccataacatacatttccttcttctctttctacttcctgaaccatttttcattgtggctatgtaagctcttccatttacctagtatcagtgactctttaggtaaaaatctcatttttcattctctgtgccatcagtaatagaaggattaagctaatttcaaagctacttgtgtcaggatttcatccaatctggaaagtctatctgtgtcatcacaggtttgcgtgtcacattctgaagtttgacaaattgatggaatgaatcatttgttgaaattcaacaaagagcacccagcccgtgttctattctctgcttaagattaatctcagctcaatattactgaattgaatttatcagcagataaaaagaaatattttcaaaacaaatatcatagtaccagcttagaatataaatctttcataacatttgtcatcaaaattgttttaatattattgcaagaatgtgttgaaatattcctaccaatagaatatgctaggttggcatcttaataacaactctaatgctgagtcattttgtatagggagaatatttttatgaatggaagaggaattatgaatctattcttaggtcaaataaaaaataattgcacatcaaaattcctgggctgatcagatgaattaagtttctggctagctgagaaatgacaaattctgagggagataaactgtcagggtgcatttaccagcaactttaacaaatgatttggtcttgacagaaatgttttaaatacagcttctagctgtttaaggtatttagtcattttgacaagactgggttagccattcctgaaactttaaaaaatctgacatgaaaaaaatggaaccatatgccaagatattacagtacttagctagtgcttcggggggcagtgactttgttgcttcctagaactagtaaaagccttaaacaatttgtttcccaggtccttcattttatagatgagaaaaccaaagtccagagagaggggcatacagtaaactaatagcagaacacagaacagaactcaggtcttttggctttcaagtcactgtatcattgtaattcaattttatgttttaaggcagtggttctcacaatgcagcaggcatcagaatcacctggagggcttgctaatacacagattgctgggccctacctcagagtttctgtttccatgggtctgggatagagccagagaatttacatttctatcaagttcgcaaggaatagtgatggtgtggctccagtgatcacactgagaaccactggtcaaagggataggagggataggcgggaaaataagaataaatgtggaatttcctgcagaaggggaaatctttgattggagcaagtattttactaagtattagtaatcagggaatggaagggtctgttagtaagtttacttttcctattgcccttgtaattattactagataaggtttttactgttggcacaaatgcctcaggaatttcttgcctggctcagaattatgacccactggggacaatgattaattgtaaatacttcttgagaatccaaatcctcactaaaaattatcaaattgcctttactcatcttgaatattcacattaacataggaaaaaagagaaccagaaatgatgactgaaaatgaacaaaatgggtaattgagttgacaaagagaattaaacttaaaacaagaatttgattccctccgattttgtttgtctgggccagttaacaaatttattgtcagaaatgtgctttaagttttccttggtgctacagaatgggaagatttcctgatactaagattaagtctaaaaaacaaattcccactgagagtctaagcacatattttcattaacatacagtttatttccacttattttctgtttttatcttttggtcagtattcatcagctagttacattcaagtagatgctttacaatatattgagacaaaatttttaggtaaattggtgataacagccttccttcctgaagtctcctttcagcaaccttccacctgctaaaaagaaatccatatttgcctacttagatgccgtctttattgtacctttcatcctcctagagaaggaaaaaatattccttgttgatctggaggctaaactaaggttttgggagaaggggagaataaaacttaaatggcttctggagcttgagaaagcactgatgtgtaaaaggtcctgaagcagctatgagggacaaaggaggtggagaatcgggaaagggtatgaggaagtgttattgtggattaagaatggatttctgttattgtactttgaaagccaagtaaagaaagagctgctttttaattatctgtagatgctaaaagagatactgcactgagattggaccacatgggtccttgaatttattaagtttacccaaagtacctaagactcaatctctgctctaataacatttgtttcttagggggaatcaaggaaatccatggaaaattaagtttccaagaaaaccagagtggatgggataaaaaaaaacccctatatgtatagtgacacactatacatatctataaattaataaatatttacagtcacatgaaagctcttgcagttggtgagatgtgaagctttccctattgctacagcagacttagaaaagagataggggcatgcagattgaggggagaacctgagagtacaggcttcaaaaagtggaaaatatactgtgactttaaaaaatattgttttggtaaaaccctgagtcagctttccattattgggaaaccaagaggtatcagttatctactgctgcctaacaaaccacctaaaaacttagtagttcaaaataatggcaatcatttattttgctagaaaatatgcaatttggatgggatttggcaggacagtttgtctctgctccttctgttgttagccgaggggctcaacttggggctagaggaaccattttcaagatgctcattcacatgggtggcaagttggtactggctgtctgctgggaattcatctggggttagaagccttggttcttccctgtattggcctttccatgaactgattgggctttttcattgcgtggttgctgaattaagtgagcatcctaagagaatatagcaaaagtgcatgacatttcatgacctagccttggatatcataaaatgtcagataatcacacagcaatcacagtggccattgaggctcaatgggaaagagagtggcaaggtgctacaaaaacatgtggatgggcttttgtagccatttttggataatacagtctgccacaaaggggaccctaaggtatgttctatgttttcaattagtatttacaacagccaaagagatggctcagtgtttctcatcttgctcctttttctccctctgtgcccgtagatagaatgcttggcccttactacaaggccagtcccagatgcaaccctgcttttccccccatctttgttcctgaggccaattttggccacttataaacacttcaggtcacagagctgagaaggagacagtcaaaaaagaattaaataagagaagcagaagttgcaaatatttatcagtggcctttctaaccaacagtggccctccctgacacactgagagattcaccaagattagaacttcacctatagtagccaccacatttattatactgtatatagtccttattttagtttgggttcccccaaagtacatcccgagacaaggatttgggagtaagtagtttatttgacaggtgatcccaggaaacatagtgagggagtgcaaagtgagattgggcagggaggaaagccaataaaatgtgtgataataagcaggttatccccatgaacaactagggctcgagcccatggagactcttgatggatggtgtagaacacatccagagttgtcccctagaaggaattaggaaagtagagtatttatacacaaatccctgtccctcattggttgggggcatttgctctgacacttgcagcttgtcctattccagcccaaacacgctcatgaagccaaacaaaggctttaggcagattgaacaaatctttccattatctttcatatgatgcttctgggcagaccaaaacagaaagcagagtgctgattagccttctctcctcttctcctccaatgggtgtccttataccttggccatctcctctgctccgtggctgtggtgggttttttttgatcctccatcccaagctatgatttgaggtacctttgctcctttattatactccatccttgccacgaatgtaggcatagtcatcctgtcattttaaacaaggaggatagggcctgtggtccccttctggtgtggaaagtgtaaaggttccctgaatggctagggtcaaggtagcaaccagtagttatagaaaaaggatacataagggaaaggaaaggactgatatagaccagtgtttttaaagtgaagctcccaggccgccagcataactggactgcttgatgtaaatctacaccaagaagcaacatactgaggagcttcagagcataggcgttggagccagagtgccagagtttgaatctctgagctacttactagttgcatgaccttgggaaattacctgagccttctgtgcctcattttccttatctgtaaaatgcacctaggtcatatgactgttttgtggattaggtgacatagaatgtgaaatgaatgtatactgcctggcagtttctaataatgtaccttttattttattttattttattttattattttattttattttattttttgagttggagtttcgctctcgtctcccagtggtgcgatcgtacagtggcacgatctcggctcactgcaagctccgcctcccggattcaagcaattctcctgcctcagcctcccgagtagctgggactacgggcatgggccatgagtcctggctaattttttgtatttttagtagagacggggtttcaccatgttgggcaggctggtctcgaactcctgacctcaggtgatccgcccaccttggcctcccaaagtgctgggattacaggcgtaagctacaatgcctggcctattgtttttattattatttctagttcatatcctacacatagtgaatcataatctatgagaatggaacctggaaatctgcatttctaaccccccttccccatgtgatttatatgtatcctgaagtttgaacaccagtgcttcaagctgagagcccaggagagagatcaggtgatgtcaagacaggattgtttaacatagtaacatctcatttccccagcaactttgggaaattaggagtttcttataagtgagttctccagatggctgagactgttctctttaaacactcaatctcaaaagttaacacttgatgtattatgcttaactgtaaacgatatatcacatgcttacacagagaattctggaaagtagtattataacaatatttttggagtgacttagttatcatcagacagccaggcagatggtaagtatttattgactgtctcactctgtcccctcgttttggtaggtgctgaagatacaaagatgaacaggaccaaatccctgctttcaagagtttcactgtctagtagaaaagagatcaggaaatgttgacacagtgagagaagtgatagaatagaaggctgttttgagctttattacagggaattcctaacagctataaaagtgggaaggatatgttaccctgatgttgagccccctgagtgcttgggcctgctatcttatagctactatgtctctcccttgctgtcaattgacactccctgtttctatcaatttttctgccttcaaaggacattcccatcctcatctactgtgcttcctttattctgctgtggtctggaaaccagataccctgaacttgatgagaggttgccgtcttagaaaggccttctctgaccttgctatctaaagtagcatgccccaactccacacacaaactctgcatctccttaccctgcttgatttttctttatggcctttagtactacctgacatcatgttacatatgtttgtttatgttccatggtctactttcttcattggaatgtaagtgtcaaggaggcaggggctctgttgtttagcacacctcagtatctagcacctaggacatggcctggctcagggttggcttctaataaatatttattggatgagttataatagtagcaaataagtttctttttaaattttttattgaggtatagcttgcatatagtaaagtgcacccatcttaagtattcaactcaataaatattggttaaatgtgcatactttataaaccacactcagacaaagatatgcagcatttccagcacctaaccagcaggctccttcaaacaatgcccatacaggacctcctccaaaagataactactcttgtgacttctatcataattgattagttttggtgatttttgaatttcatataaatgggatcatgtagtttgtgctcttgtatgttagccttttcaacattatgtctgtgttgtgtgaagcagcagttcatgccttattgcttgtaatattcattgcatttactgcagtatgtttagtccattctactcacatgtgtgttgtttctaggttttggtgttttagaaaatgagctttgagaaagtccgtgaaaggtgccatgagtagagggcatggattcgatagcaactattctgtgtgcttttcctcattaccccattttatcagtcctacatttctcgaactgtcccctttcttcctgctacttcagggttctgatttatgcttggacctgggatgtctctctggaactaagtcaaatttacaaaacccctagttggactagtgttgtagtaaacccacattcctgccagttcatcccaggacacccaggacacagaagcagaatgctgattagctttctctttggatatcctctcttttacttcctcttttgtccttggttcttgtttgctttctgctaattccctccactaactgggggcacctttgggcctaatgtgttttatagccatgattctcaatcatggctgcacattataatcacttggggaacgtaaaaaaaatacccatgcctgggccccactccaaggcaattaaatcaacatctctgggggtgggacctgggtattagtatttctgaaaaactgttcaagagattttaatgggcagccaaatttgagcaccactgcgggacacattttgttttaggaaatagtgcagatgtgtagaatcaactcacttctttcccccggcatcaggcacaaccaatttgtttccacacaacttaccagatgagactcttgaatgttgtcaactttataaatcttagggagcgatttatatgagaactgcttaaaaacaaggatgtcaaaggaagcggctttttcttctaccatggttgtcactctatggtgtcaagagaagtgttagttgaaatttggctcatgaattacaatttagatcaaactccaagctgtggcagggatgtcttgactagcattgagtggatacttctgaaagacttgtgatttttaaaaacatgtgtaccacatataagcacaattagcactactaggttacaagtgtaataaggccagggtccattttataataatctttttcctgacaacattcaacaccattttgtgtactgcaactaacatttactgagtactttctgttatttactactcagcatttacaactcaatcctcactattataccagctgtcttactgagcacttatgtgttatgccctgttctaagctctttaaagatattcattcatttacttttctcagcaaccctatgagttgggtttttattattatccccattttacggtgaagaaactgaggcacaaattggttaagtaccatgccaaggcctcacagatggtaaattgtagagctaggattcacgcagtttggcctcagagcctgctcccttatcatctaccctgtgcttctaaaattttaatgcgcgtagaagtccccaggggattttgttaaaatttggattctaattcagtagatctgggatggggcctaggagtctgcatttctaacaagctcccaggtggtgttgatgctacagatttatggaccacattttgagaggcaagaacataacttatgagataatttctattattgttcccattttcaggtaagtactctgaagctcaaagaggatagtggtattaccagcttctcatagcaaatatacagtgaagctgtaattagaattcctgcagttgggtgtcaagtgtgattgcctaactgctctgcttaggtgcttggtaaatggctattgaatgataactaaactgatattcagtttactgctgggtctaacagatggctattatatagtcaaaggttggaatgtattgaatagaactcaaataattatatgccttccgtctgttctttttacaccttggaaatgaatctagtatcaattttcatctttaccacattttcttctcatagcctaagcaggttgttccacccttgctgttagcagggaacacaaaggaaacaactcagcaagttttcgttgaggatatctttctgtgggcctgtttaccattgcctttgcttttgaaaaaatagcacagaactggaatcctgctgatataaatatttctcattaaattgtctgaatagcgatcccagtagatatagaagcaatattattcaaaataattaaaaaataatgccactatttaaggttttgcaaaaatattattttccacttttgtacaaaaggaaatattttcatcagtagccttgactcacactcagtgcaattttgtggtggatgagattcaggctcccattccccattgtgtcctaataccatggatttcctccatgaagggtctcctgagaacaaggcccatcagagatcaaaacaagaatcaaatttagtgttctctataacaattcaaccattaatgttccaggaagaactctctatccactcctaccactctgaaatattttccaaccagataatgcatatatatatgtgacaaagagcctttgcctggaagaaaatttatttacttattagattattttaagaggcacttcttggctcagagaactggagggaacaaaatatataatataaaatatgtggctcataaaaatatgtgacttcacacaaccaaaatcaggggcgaaatgctagcatctctacattgtaatggggtccagtgttaaaaaaggactcttggctggattttattgactagcattctaaagttgttactttctctgcagaaatgtcagggaggtactagcttgtctcatttatcactgatgggaataataaacctgactagaagatcagtgactgtattcactcattcatacattcagttcctaaataaagattgttgagcatcactatgctaggaacttgaggtaacaaggagaatagcatatggtttctgccctcagggagttcacaaaattactagggatataatacaaacaggaacaaggttaacagtaggagatggtatgtgacaaggataatacaaatggtacacagtttcttagagtagtgttttatcagagtggtccctgggccagcacatcagtatcatctagggacttgtttgatattcagattcttgggccatacctcagacccactgaatctgaacctttgtggatggaccccagcggtctgacttttaacaagatcctaaggtgatttgtatgtacattaaaacttaaaagtgctcttttgaaagatcacttctatcagaggaagaacaacacattaaggtcttgtccttgagagcttataactcaaaaaaatgacatttgaatgtgaataatcaaatctgataagaaacactcacacatgtgactataggaacaaggaaaagtgggtgggggggagggagagagagagagattgactgatttaaccctgtggtagttggagagactggtgaatgtttcctggaggggccgttggaggatgaagaaatgctgtcagtttgaagtgcatttggctgtaacagaaaacctgactgagagtgatttaaagaagaagggtttttgtttctcacataagtagcctggaggtaggcagtctccagcgctgattcagttatttaaggatgccagggttctgggtcagcgtctccttagacctcttgctttctgccttatgatcaatcataagatggctgctgtagctctgaaaatcacattctcatccaaccatattcaaatgcaagaagcagataggcatagcacaaaaagatccctcttctgcattcttatcaaggtggcaactcttttctagaggcctcccagcaaatctccactatgtctgatttactagaactagaacataagactaccagtataccagggtctgttcaactttccatgacttctagtaatctcagcccaatattccaggaggatagagctgctgttagcagggagcaagtgcgtttcagtgggaaagcttttgagtaagccaccaacagcctatagccaggaagactagagtagatggaatcaggagtaagggcatttccccaaagagggaaaggcatgaatgaaggcatggaggtgaagtgtgcatgaagaatgattactagatgagtttggctaaagcatatgagtcttacaaaggaatttttagccattaaaaaaaatctgtggaaccttttgttcaattggaatcatgtgcagaaacccaattcacagaggaaagcatacctgcttcagtcagaagtagggtgggatgcctggagccagcctgctctgtctctgacctacttcagctgaaagggcttcttgaaagccaaactgaagaacaatgtcccagaaactgctactttgaccctgccacacccaagattctctgggcccctctccctgcaggaggccacaaggcattcatcaaggtccctcatttggccccaaactggagcttcacaggtatgtatggaaatataataatccaggctaggggtacctgtgtatgcgtttttgtggtgttgctttttgcagataccacatgtgaccctgtgtctcttaattccattcctgacactgaattgctaaaacagtagttgaggagagcattgtggtaaaacaactagaggaaggggaacactattagtggtgattagtggcttgcctcttcacttcctgcccttacaaccctgtgttagtttcctagtgtggtcataacaaagtaccatggattaggtggtttaaacatcagaaatgtattatctcacagttctgaaggccagatgtcagatcaaagtgttggcagggttggtccctcctgagggctgtaaggggaatctgttttatgccccttccataacttctgatggtttgctagcagtctttgatattccttggcttgtagatctctgccttcatcttcatatgacgtattccctgtatgccttcacattgtcttccctgtgtgcatgactgtctttgtgttcagatgtccccattttataagacacagtcatattggattaaaacccaccctgatgacttcatcttaacttgatcatctgttttcgaataaagttatattcacaagtactagaggttaggacttcatctctgtttggagagacacaattcaaccagggaattgtggaagatggcaatgaagatttatcccatcttcattcaacccctaacacatcctatatttcaaacctttgcttccctttttctaaggccttctcctctcactcttaatcctagtggctatgctccagttgtttaactcttgttatggtggaattgagtgggaaagatgggttatttcaaggaatgtttcatcctcactattctgtttgaagacataattgtgtagaataatgtttgaaaataaacactggcactcaattatattaattcaagattgaattataattcaatcttgtgcatgggatcctaagtttgaataaaaaagtgcagaatcaaaagaccaaataaaaattatcacaattattaccaacattaccttgtatagcactttcgcacagattatcatttgaaagcatattcttttctaccagcaatcaagatccccttttcacatctacttttgcttgacaataaattctccttgaggatgtttcctgacaggattgtctgcggaaaatcctttacttagagttgtaaccagaatcttcctaaatttagcagagttcatacaacactgagctgaaacccaagtaagggagatggacagagacaataaatgagacactgaagaaatataaaatggaatttaaaaactgtaaattttaggggggtaagggcacttacaaaagtggggttaaagaaccaagttatttttagattatgtggtcctaatttggcagcatactttattattaaattttgaaacttgctaatgaaatactagttcttagtgacaaaatctgcccttgatcaaggaagcaaaaaggagaagttactccgcaggtatcagtctctccactttcttacattcaattctgttgtcaaatgttaagactgtttcctctcattcagtggaaatttccttcagcttatttttcctggaaatggaaaacagctgcgcagagccttcattcaaccctctactcaaaggctcttatttgcatcatcaactatttgcttttctctatcccaatctatcaataaactaagttcacatctcttcttcagagcatttttctccctcagtgtggatgccccatcctcataaaagcatgacacttagtcattgtttatactgtcattcctacctagaaacgtctttccctcttaatttttttggaaaaatgtaccccatcttccttcaagacttagccagggagagagctctggagcacatttgggaaggcatgaaatggggaagcccccaggaaggaaggtagacaaatcctcaggggacacagcctggttttctcctctgtgtagactcctaatgtgccattcccaagatgctcctcaatattgacgagtggggttttctggaactgtacattcctaagagccagttgacttctagagtgaaatacagaatgtgggaatctccagagaaagaaagcccaaggcaaaagagtaagtaactcttagagtctcagacatggaaagataactggtaacacttggctgctggagaatgaaacccctcctaaaggcagatattcaggcctgtgatagaatcattgaatttcatctacctagttcccatcaggcctggggaaatggggataagctgcagagtctacatggtcttacagaagctgaagcaagttgcagagaaatttcaaggacttttaagtccagtataccttggatttggggcactactccagcacaaattcctccctgcttcatgcagattttcattgccgatggccccacttccagaaccagaaattccaacattcctatggcggtcttactttccgttgccccaggaagcagaaatggggacaagactgcaagactgaccatgagaccatggcctggactgaggggctcagctactttcttaagtaccttcagaccagagataacagctgtttggaacatataaatgagaccttgtctctggaacaatcatctggctttggttattcattatcattgaaccccacatgcctcacttagaaagatgtcccttccaaagctcagaggccctcaccatcgcatgcatgctcctctcctagtacacttctggagtggcctgaagagctggagaagtgggcactcagctcacatctcaacccagatctccacagatcacatccttgtttctgtcacatcagtagtcagtagtgcccccatctcatttatatccaaattaagaacatcttaatatgagatttcatcctttccagattgacccatctggatttggatatctcagtaacaagatactttgtcctttttcatcattacttagctcctcagtttgcaatatttgtgtgtccctattattcttgtccagttatacaagccttgaggtaatgcactgtcttttattagtttttcagactccacacagagattgacacagcactggcagaacacatagataccattgcttaataagaaaattcaagatacttggttgattctgaaggacatcacttctgggatcctgagctacaggcattaagcttaaggaaaacctggttgaagatcatctttatggtgaaaataagtgttggtggatcaatagcaacccattacagatattttcacattcactgaaataaaactttaaaagtggcactctaactaaagagaatatcaataacattttatcactttaatatttggttacttttttctattttcctcagctcactgctatttcaatgaaatgatttgttttgctttgttgaagaaaatattcattagttaaaagataattttggactatgtctggttgtatgtccaaatattcggtctttctgattttatgagatagttgaccctgaactccaagtggcccaccttagttaatcaccatattccagggatgtgaaggaacttggaagcttgaaatggaataagctgcattggagccagttgcactcagcccccttccccttggctggtggtatccctttggccctgcttcatggctttaggccaaattgcctcctgtcagcatccctcatacacctctccctggtgccgcgtgaggatagttcacagttctgtggcctgggatgactctcatcttccttcatctttcccaagacattattgccaaacactctcctcctctaccattgttttacctcctaatcctcaggtctctttttttctaagaaccacccccgtcccctgagattgttcccttcaacttgacatttccctggaatcacaattcttatagtggtaaaaaggtgtcagaattatatgtacatgaaaggaactcaagttggagagaaacttggatacccataaaggaaagtttccaatgctttcatg

SEQ ID NO: 1066 - DNA, 474 bp, mus musculus
aggacagcggcgggccgcccgcggcttccctaggctccgcctcgctgggcggagtcggttgctgcacgtacgcggcgcgcgaggggaggcgaggagcgcgaggggcacgcggccgcgcgcgccctccactgattggccgccgctgcctctgtgacgtttgtgttttgtccgggcgcggcgccagagacccccctccctggctcatgggactcagcccagcccagcaagtgcagccgctttcagctccgcctctggctgggttctccgctgccgaaaggtagccgaggtgcccgcggaccgggaagaggccaggagcccggaatccgatcctccgcgctgctcaagacccttctcaaccgcaggcgccttttccgggaggaggacttgccgttcgctgcatcctgacacttagattttacagcctaactagactgactctgtttcgtggcccagccccacccccacctccctgcc

SEQ ID NO: 1067 - DNA, 4896 bp, mus musculus
cacacacaagaggagagtgttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttgaaaatgaaaggctcaggccgtctttatttgtatagcagtagttcatgtaacattatccataggttcttgaagactacaacattaagcaaaacaatgtacagcaggtgtacatcgtacaacaatgcacaatgtatgacattgttcaatgttgttatgacattgttcaatgttgttatgacattgttcaatgttgttatgaccttgttcaatgttgtttagttatgacattgttcaatgttgtttagttatgacattgttcaatgttgtttagttatgacattgataaggggaaaaattcattttgttagatgttatttcacttgaagtcacaatttccaagaaccagtggactatgttaagtgaggacttactgtattccatcaggtcccatcacgttaagcatggccaaattataggagatttggaccataggtttacaagactctttatttttttaaaagacagggtctcactctgtcacccaggctggagtgcagtggtgcagtcatggctcactgcagcctcaacctcccaggctcaagcaatcctcccatctcagccccccaaagtggtgggattacaggcgtgagccactgtgcccagccttggctagactcttaactgtactccatcatcttaacaaacacagctcttggttttgttcaccatgaaacttgtgatatgggtcacaacccaataaggggtatggctattgagaagataaatgcttgcaatggggcctttggtcattgagtaaaaactaaggattagtgactcctgggctgggaaatgagatgatgtcacctttgtctctttcatgcttgggttgataggaaaggtgggaagtcatttttaaattcagatcatgacctacacttggggtcagaggcactggatacttctctgaacaacttcttgaggaaaacaccaattatggattctgaggtggctacatttattggcaagagagtggccttataacctgcaaataactgtcaacaactaaagaaccttctgtcttattaagtgggtagtgccttaggcacagcagtatacctggagagagagacagtttgctttgctgtcaaacctcatactcatgagctagttgaataggtgtggggactgctggcacaacaccctgggctcattcatgctcaggtaaaggcaatgtatccttctacattgtccctttgtgtgtacatgtacctccagggtgtctaacctgtcagagatagccacactggtcttgttggagcatcagtattttggctgtactgcccataggtcttcagggcacccatgtgggaaatgaggatttttattttgtcatacataagctaacctaatccacacggatgtgcctcatacgtcttggacccagttttttaatcattagaatgtcaatggcaagagttttatttttatcataagagctctatgcactgaacctcatacaaaatacaaaccatccagtacttggtaagttttgccctggaagccactttataagcaattatttttgctgctgcatcaatctcattgttttgtaattttagtgatttaccagtagtattttgtggctgtgttccactgataggccaaaaccacaagccaggacagaactctttgtctccatccaatttggatgatttcccatcaaaaactggctcctaaatgtctttctcattagccaattgtttagcaatttccctaccagacattctgaactgtttatatataaatacaaaaaccttcagagaaaaagacaatttttggaaatagattttagaaaccaattatttgcatttcagtgagaagcagatcatccaggtgcttggagatactggactgtctctttaacaaagtagatacaaattcgtggtaacatttctttctaacttcctggatacatttctttatagttgttgatatctgatggtgttctccaatactccaaattggggccattcacagagtactagtttccctagggcatccaactatttataaaaaccatgttcagggcagtttcctttcagagatcccctatttcctctaattcaggtcagtttgattt

SEQ ID NO: 1068 - DNA, 4896 bp, mus musculus; identical to SEQ ID NO: 1067

SEQ ID NO: 1069 - DNA, 4939 bp, mus musculus
tgtttaaacaaaaaggcaagcttatgccaacactaacagaaacactaatatgtttacagtcacacttctgtctgtaattacatgccatgtcaactatcatggtgggacaacagtattgaaaaagaaatcttttgaaaaaattgaacaaaagaaaccatgtgagcccacggacaatcacaagatctttatcctaaaaaaaaaaaatttgtcctttgaaaattctatagaccataacaaaagcatagcttatgatagttttcatgggaggaaataggtctaagggattaaggaaacaatgtgacagagttttaagatatctatatagttatgtatcttaatggatgcctatgacccttgcgttcacctcaggcctctgcattttctataggaaaataataataatctatttaagaggacttaactaatgacaacacatttctaaaatggcttaaaatctttctaaaatactaagggagaactgttaaatggttagacacaaaattctatttctttgaattacaaatttatgtgtattttttgctttttcattgaataagtacaaccaacttaaaaattataaagacagtaaagatgtatatcaaggtggtatatattaaagtgcactgttaaagtgccataataattgttatccccaagtatccacatgtaaacaatactgggttacaatagttgaaagcaactaatagtgtttgctaccaggaccacactgtaaaaaaggaaaagtagaactacttctcactaacaccttatataaaatgtctccattattatctgattcatgtataaacacattgccatctaaatccagaaaattacttctcaatgtacacacatacttgcagtaatactgtgactgaaaaatgggccataagaagaatggctgagagatggtgaccatgaaagagacgtgtctaatttaaatgtaagtaaaagagattcatggcaaggactggtgtacacctacaaggaaatagcatggagtacaaagaatgtaagagaaatcaattaaggtgggaggcagcaaacagttataaacaaaatagtcatgaaactcaagagtcgaatgggagagtgggaaatatttcctctttgttttgagctacacacacacacacacacacacacacacacacattactaagtgaaatacatttgtaatctgagctaggtaaattttaatatgaattgtagatctgactttgccataattacctcacaggattgtgaggatcaaatataatagttgtgaaagtgctaaattgtaaaatgctatactcacataagatagatggtatctactcaaaatgcagacaaaaccctctcatttcaactctaagagtaagccagcaatgagctctctagggcacagaggggagaaaaatctccctctggtctatgtccagattgtcttggaagaataggctgaatactcattgcatgagctggctttgaatgcagaccgaagatactatcaaattggtctaatggacatgtggccaatgccacaaaagaactgtgtgtagaaaaatccttaatctgttgaagaaataacttccttttcctctttcttaaccttcacaaatgtttatttcctgcacaatcctgatactaatttgtgctaatttctcccctttgaggagggaaaacaaggggcaggaaagggaatgaagattcaccaaaacatgctgaaacacatataacattttcctttcaatacaacctactggggtagaaaaataagtctaggatgtaacacatatgttcacattgctatgaccattttacagatagaaaactgaggctaagagagactaaataacttattaaaggccaacttattcaaaaccacaaagcaaacatttcactctgggtctgagtgataacaaaagcccttgtattttccacaacaaaaacataccttcatcatttaaaaaaaaggttagaaggataaacagctaagaagaaccaactcctatttttagctctttttttttgagctctatcattagattttcgtactgtgtaaaatttccattaaatttttaatgtaaaacaccagttcctcaatctttcattatttagtgctacagggctcaaaccgcttctgattacaagtacaaacaataataattgcaaaatgcccgaaaattttcaagaaaaagcacaaaatcacaaaacaaaacaaaacaaaactgaaaagaccttatgagcaatgtgttcaaaccaccacaatttataaataaggaaattaaggctcagataggttaagtgacttgctgagggtcacacaacttgtcagttccagactcaagatcagaatttagatctccaaactcatagtccagggctgtgctctttttgcaaaccaaaaagaaatgactgcacttaaatatttagtccagaatatcctcaaaattgactgtaataaaagttagccacatggcaaggaatgaatagagttgcttcataccaaaaatgagctgccagtcacagtgataagatttctttctttctgagaaccatggtttcctgctgcattggggaatccaaactgggtttctccctcctgtccaaagaagtcagagttaggatgtacgctccactccgctttggctggtgtcagtagttctgagacactgttttcacaaagggtgctcgaaggagtcagagtatctgtgtccactgttagcttactgctgggtgtcaaagcctgaggctctggactggagtttttcatggccaaagagtccagagatcccaatggccccacacttacacttgagacctcatccatatttaaggagctctgctgaaaaccagtggccgccgttccaaaaaagagagaggtatccagactttgaggagggtcgctggtggccatcaaggacggagggtccacagcctgccctacggaattattattattagcagggaggtgccctgccagagtcgagctcacagaagccacatcaatagtcaagattccagagttcaccaatgctgtgtccagcaatgcagcagaagtactgtcaggtacatcagagaagagagacactatctctgcatcactgagatcattctgtctctggctggtaagttcactgctgggtgtaagagaatttgctgcttctagctgagctaagagatcctggcccaccttatgccttttaaccatgtgcgtcttcatgctgtgcttggatgtgaagagtttattacaagaggagatcgggcaacggcttttccaagtgtccacatcctgcaggtgtttcttggagtgaatgtagaggctactgcgagcagagaacctggcacagcagcctgccacaggacacacgaaaggctttgtgcccaggtgggtaatgctgtggcctttcagatgttcggccctcgtgaaagatttcccacagccttccacagggcacatgaacctccggtcatcgtcgtgcttccttttgtgccttaagagtttggacatgctggtgaagttccagccacagccatcaaagtcacaaaggaaaggtctctcgccggtgtgactccgcaggtgaattttcagcctacaagccttgtcatattgcttgctgcagccagggaaagagcaggaaaacagttcctgttccctgaaatgggcgcggttatgggaaaacagagcactcactgtgataaatgtcttcttgcagccagaaaacgcgcactggtaaggcctctcgggttcgaagtggctgcgctggtgggcgccgagtttggcctgcgtggggaagctctcctcgcacacctcacatttgaacgagttctcctgctcatggcccttcatgtgcgccttgaggttgtacacggtggtgaagctcttgccacagccctccgcagggcagccgaagggccgcagtttatcgtgcgactgcaggtgcctcttgagcttgtaagaggtggtgaaggtccagccgcagccacccagggggcatttgaagggcctctggccctggctgctgctgtgcgtcagcaggtgcatcttcagctggtgcttcttggcgaaggtttgcccgcacagcgcctcggggcacaggtacagcaccacgcctggaccagagcccagcagtccgcgggggcccagggcggcggccaggccctccgcctcctcctggggcgccggagcaggcgcgggttctgcgggctcggctagcaggaggtcggaccgcagctctgggcagtcacccgggtgcgcggcttgcgggaacccagcttggggggcgatcagacacctgggctgctgggcaggagcggcccctggctcccaggcgtgtggtgggggcgtggccagggtgaggacgccgttctcaaagcgcaacagcaggtcctggttgtggatagtgactgtgcccgcgaaggccgcggcggggccgggggcggagatcggggccggagtgggaaccgcggacaggcagtgggggccctgcgcagagcagcccgcggggttcgcgccgctctcgtccccctggagccccgggcccgccttggcctcctccctcaacacaggccctgcggcctgaccggagcccgcggtctccacgtcgccacccaccgggtcaagcagcaccaggaagaagtcgtcgccgccgccgctaggttgatggggcctcggcgcgaacaggcttgggccagggccccgtgatgccgtgctggcctcctcgcgccgccgcccgggcccgccatcttgggggccccggggcagcaggaggcggcgcgtggggacctggccagccggcgagtcagggcctcggtggactcggccgccacccgcggggataccgccgccgccgccgccctgtagtgtcccgcgagccgggagcagcttcgggatttccatctctgcgtccgagaggctcggctggaaccagagccgaggaggaggcgcgatccc

SEQ ID NO: 1070 - DNA, 74326 bp, mus musculus
gagcggcgcggaagccgggccacataaaggagcgggcggcgcgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacggtgagtgccggaggtgggcgctgtcgaccccaatggctctggctgagcctcatagccctttgctgatggctgagggcttggccagccaccggcccgcctgggacgccgcgccctccgccatagccaagggtagggaggggaccggagtgggatcctggtctggtgcgccctcaggggttgagggggtgtccaggctggaagtttggacggggcgaggcctgcctctttctcaggttccagttccctgtgtctgagatgcaacagtcaggacggcttcgttggggcctggggtttccccttttccctgatgggccatgggcacagaggagaggattctggtccagaagacaacactttccccaacccaggaattggcacctttctggggcaaggctgccaatgtccaagaggggacatgggaacagagaagcagggagaaaggagggagccgctcggggcggatccggcacccccactcatctttcccacagcctcaccgggtggctccagctgttttccactaggaggtgaggagagagatgtgaggaaatcgtcatcgaggctgcacccgagagcaccaacacttatttaggcaccagtctgaggagaggcctaccccatctcctgggagagaggaccggtttctccctcctctccacctccaaatccctgcccctcctattgcttaatgcctctctatctcctcctatcccctccggactattttgtgtggtgtgggttttctcgtggggccacacctttctagagtggtggttgatttggggatgcgtctccaccccactggctgttacgagaggaacagaagcctcctgggagtggggataggggggccggatgcccaggagggagaggggaggaggggtgtgcctgactaatgagctctgcttgcttttgtgcaagtcatgccaaatggctgctgaggcccttcccttgctcagaaaggcctggtgaccaccctggcttgagtcccttaggccaaacagcttgttgagctggcctaggcaatgcagtgctcccaaacatgtctccccaggactgcttgagccttgtagaggtgagatagtgactagtagccttgaaaagggctgaaggtcccctgggatgagaggaggagagttgggggcccagccttttgggtttgtgatgagctttggttgccacgttactgtataccagcctcactgccaagtcgttcttgcctttccagaaccttgtccttcagaaacaccaagttttcaaaaagtatgtgctttcactgtctatctcctttaaattgcttgtggttttaggacatgaggcttttacacactttgttccctagtccccgcccccaaagagagagagtaatggttttggagagaggggaaaatatcccattgtctgccaaaacaagattataaagatcctgtcaggagcggctctttgggtctctctctgtggttgactcctgactcctcttaaggtgcggctttgcctgaacagttgggtggatctctgggaatagacattgctccacggtctttcttctgtagtggcatatctcatcctcagttctgagatagcccactttgaaacacagcttcatgggcctggaagttgcttcaaacttgcattaaccgtctcatctgagtcaaagtggcaaagaagacaagacagcgtgtttattgttttcctgggaatggagagagaatggagtataagctgtttgtagtcaggcctggagtaatgagggtacctaaatactgaaggcatttttatgcagattgactgaaacctgaatcaaattggaaggagagggctgaattttgatagactggaagtattagagaattttctatactttgactcaaggaatggtcaacttttaggaaaagcaactatattatgtctgttaagatcatagaatcttaacctgaaagggaccttggagactatttagtacaactctcttaaaaaaaaaaactaaaactaaaacaaaaatctaatgaggctattgagacctacagggaaagacctacctaagggcacatggtgactgagccaagattggggtccaggctttctgatgctcatctcattgaccctttattctgacccaatgattgagttcttgacatttgagttccctttcttgctccaaacaaattgcccactgttctcagacctttatggtcctcagataaaaggaaatgagtaatttgagcaaagtggccaaggttgacatttgtgtggtctcctggtaaggttcggtagtgtcaccaggtgccttctgttacttttcttattcctcataccaaggccaaggtgttcaggggcacaccctagttcactgaataccaaccagtaattttaattaaaaggggaaaaaatttccctttctctgctccattttcatttatgtgctttaggctatttctagcgtgtgacagatggagaaaggtagtggaaaatcaaactcgttcattcatattgcagcatgtctacaacctatctagggtcggtttcacttttatagctaattgtccctcctagtcagcccaacctcccctacatttgttaaaacacgccagccgggcgtggtggctccagccagtaatcccagcactttgggaggccgaggcaggcagatcatgaagtcaggagttcgagaccagcctgaccaacatggtgaaaccctgtctctactaaaattacaaaaattagctgggcgtggtggtgtgcgcctgtaatcccagctactcgggaagctgaggcaggagaatcgcttgaacctgggaggcggaggttgcagtgagccgagatcacgccactgcactccagcctgggtgacagagtgagactccatctcaaaaacaaaaaaagcaaaaaaacaaaaaaacatgcctcactacccaccgccacccttgccttcttgccattccttggactctgcttctggttgccagtttcctgagtctgctttagtagccagaatggaaaagcttattaattgccatctacattttttggtgatgatgacagttatatatatatatatatatatatatatatatatatatatatatatatatatatttaaaaaggcctttccccctccctaccttctttaatttttttcttttaggatcacaaaggctttgaggctttcttggatttcctaaaaaaagagtgttttgaattttcgagatgttcttgagtttctggtttccttccttgggatttattagatgttagtattgaaaaggctctccacaactataaagtccaattcctctcattgtatagatgatgaaactgaaactcatgttagggggagactaacctagagtgatgcagtatgccagttgcaaaactaggacttgaatctaggtcttagttagagggtcagtcttggtgaaacacctctttgatctgctggggttttagccatagatcaacagatcaggggaaaggcaatcgagtggtcatttgatgggaccatcaatgtgagcagacatagagcctagatccttgaagtatttgaaggtgtttgggtcggcattcagctaaactttaacagggactatgtggactgtttattctcctgccattcctagcattacttgagccactcgagtggcactaaagtggtacttggtaaataggagccagattcttagtcttttaacccttgaaccagccctgcctacagacttaagtggggggaaaaggatcaggaagagaggtcatatgagagaggatcctgcatctctccacttgggttcttcagttcacttggccctttgtgaaagtgtagatgatagagacagagcaggaaccatcttgggaatttcctttacgcttttcttttaacagccctctgggtagggagggggctggtggggcaggaaggcctttgtgggacccacaccaactaatctatgctctctcgtgttaggcttggagagggaaaggttgctctgtgagtcagtgatagaagtagtattgatcactaatcttctaactttccattctctagctgcctgcaacagtagcttgttttagggtgttgttcttacttttctcttacctcctcctcccatgaaactactttaccgaatgatggagctggaaaggacatttggaagtcatctagtctatttcccctgcctccaaatctaattctctctggatgagataatatgacagctacaattattctgaactctgttctagtgttgcatggcaacagcctgtcttaggtccctttgtatctttctgggagtttcccccactggaatttctagactcagggtccccagaggggagaatatctggctaccaacactaccagagttaggcctttcataaccatagctgctggaaatttggcattgttacagattgctaatagtctgtctctaatctttcaaagatagaattgaatttatcatgtgcctctttcctaactcagaatcttctttccctgccacctgctctattactttgcttgcaaaaaggaaaaaacagggtacagatgtggtctcctttgggatagtctgttggttcaagtgaagggggtggtcttttcatgactgactggctttgctgtccatccctccttccatttcatgcttgagagagctgaaaaacttttcaattccaggttctaatctgtggtatagaagttgtcactttggaggattagctcaggattccatgaatttggaaggtgggtgctgggaaatggaaagcatcactgaactgagaatttttcttctctttccatataagaagaacttctctcctgtcctcagtaaagtgagccaaatgaagtgggactttaggcaagtcctttcttcaggccctctgtctctccagcttgtcatgagggagctgtaccagtgatgggtaaactctaggaatccctccagtactgatgtttttgagaatcttgatggtataagagcattgagtctcttatatgtatgttcattccttcagacattctttcttcaacatttgggtaccttctatgtgccaggcagtattggaaatacaaaattgaacagcgcttattaaaatgtatcctcttgtcccattatacttcttgagtgctgtttcttcttaagtgctgagttcagaatggactgtttctcacatgggagttggtttgtttcattagtagatccaagaagaatactggcttgagtactcttggccatttcttcccgagtcatgggagagaaagggctgtgtctttccttactgtggaaagaaataaaccaagtgagagtatattatgaagactgtgggttgactgaaaagctttggacaaacactaaaagcctcatagattttcctgccattcttcccacatttttcagtgaccgcctgcctgatagtagaatagtcctttttatttctgctgaaaggaaggcccggaagctactagattatgtttcagattttcttctaacatggtgagtgtggtagttagatatattggtagatattgaggccttcctaagggctcctaaacaaacctcataaagtatctaccaccagtgagctgaggactggctattgtggggtacagctttttttttttttttgatacggagttttgctgttgttcaggctggagtgcaatggcacgatctcagctcactgcaacctccacctcccgggttcaagcgattctcctgcctcaggctcccgagtagctgggattacaggcatgcgccaccatgcccagctaattttgtatggggtacagcattttaaaggcatttgcatctagggcaacccagagcttccctagccttaagctttcctttagctggttgttctggatgggcagggtttctcacaggagtgttttgaaccatggaacaactgagctggccttaaatcttctgcctcagcctttatcttcttgatgggggcactaaagtccagaaaagggaaaggatttgagtgaactggtgatagtgccaggactaaaacctaacttgcttggctccagtgtaggggagggatggtgaatgcctaccttctaaatggcactcactgtgaggtgctcagtgtcttctccctctgtgctggtggtgacatgaccgtggagttatggccatgggaagagcaagttcctctgagtgtgtagagctgatctcatgggtttctttatttggaaatggctcaggctctgaccttgtctcaggaactctttgtagcacttcccaggaaggtaagtgttttgctttggcttgtgacgggtggtggaaggcatatgtgtaggctgaagggaggtagagagaggacactagtcacattttcctgcttgagactaggccttgctgtcctaagaaactttagagagtaatttcttcatcgtattcatagccagaggggttaggcagcttgttcgaggtcacatatagttggtaacagtattgaaaggagaacttggatttcctaattcccaagttagtggtctcccactggacttggctgtcttagaaggatgactccacccagagagcacagacttccagagaactggctctgtggtgattacattaacaagatgggtacaatggagttcccctaaaatggttttgctatagcaagtttttctgggatctccgatgactgtcttctcttcctgtctacccctcaccccagttccctgctttctctttgccctgtttaattttgagctctgacctttttgaattctgaattctgactcagcgctccagcttgatctgtcccttgagttaggagaacagtatggcactttttcaatttagtgacagtatttgctgctgtagcaaattgtttgaatgcagactagaatctcctggcctcaaagttcaccactcacctctaggtgcttataggccaagcctggggcaggaagctaaaaaaagacctttcaagcctccgtggaaaggaagcatagagtagtgttgaaaaacagactctggaactagactgcctggactcaaatctagctctgcgaccaactagttatatagccttggacaagttatttaacttctgcacctcattttccttaaccataaataataatagtacttacagagttgctgtgaggattacatgaggtaatttatgtaaagggcttagaactgtgcctagaatctaacaagtgatatacaaatgttatgattatttactgaattttactatatgcctaactttgtgctagatgggatggataagaaagaagacaggtagttgaattcttaccatttaatgagtggttactatgtactatttaccataagggatagaaataaatgaagggatgatacaactgctgccttcaaagatctcctatctcctatttaattggggatttagggctaattcacttaaaaacggcttgagaaaaatatatactttgcattgcattttctacaactttttgaggagaaagggtttactgggacatgaacagggccttaaagggtgtgtacacttgggagcagtggccgttctgggtgggaaagtgatgtgtttttggtatgtgggtgtaaaccaatggccctagaccaatgctctcttgaaagttactttatctgaagtgaagggaggcttgagctgctgactgattcaaggggagccacagatataagcatagatgaagctactctttctagggtaatttggatccaacaatcctttcttaattggcaaacaagggcctgtgggggagaccatacctttggttttccagaattgggcaaattaatttttttttttttgagatggagtctagctctgttgcccaggctggagtgcaatggtgcaatcttggctcactgcaacctccgcctcctgggttcaagcgattctcgttcctcagcctcccaaatagctgggattacaggcatgcgccaccacgcccagccaatttttgtatttttagtagagatggggtttcaccatgttggccaggctggtcttgaacttctgacctcaggtgatccacccgcctcagcctcccaaagtggtgggattacaggtgtgagccaccacgcccagcctgggcaaattaatttttaaaaatgttgcttttgttgcctaagtaggtatgtgagagggtcttttcttcatgcttacacatgaactaaaccaaagaatagagcttggcaataactttatgtcagcagcctagaaacagcttttaattctctcattgactttgctataaaatcaggtatttgggaaagggtggagatggcagggaggatttctcagtgtgtggttgttagaggtggaggagtatgacgttttctggccagggcacagctgcagcatctgggtcttgaatttggagaaaaggccttttgggcgactttcaaagcacagccctttgtctgtgcctaatgacacagataccagatctgatgctcctttcaatcggcttgttgtggcataaggtaagtgttgacatagctcttaggccactaatatggcaaatggctctgtgcttgcttagtagaactgttttgccagttatcttctgtgattggtgacttcgaatattgaagtttcttcccattcctggcaacccttctaccttgtgggaatttgatagatactttgtgcatccagggtagtgatcagggcctaatgagagaagagttgagatatgacaatttggttgtacaaaacaagatataatcctgaaaatttttttcctgggtatatatttgggaagtgactggggccaaggcctaggagggggaacaaggcatacctgtcaggcttgatcagtatttctttccctctctttagccttggcctccattaaatacctgagaaggatcaagtcttatttttctcaagttgtgtgtttagataaggttcctgatcttactttcgtgatctaatctgccttccctccaacccatgatccatttccttttttttcttttcttttttttttgagacggagtcttgctctgttgcccaggctggagtgcagtggcatgactttggctcactgcaacctccatctcctgggttcaagagattctcctgcctcagccacccaagtagctgggactacaggtgtgcgccgccacgcccggctaatttttatattttttttagtagagatgaggtttcaccatgttggccaggctggtcttgaactcctgacctcgggtgatctgcctgcttcagcctcccaaagtgctgggattacaagcgtgaggcactgcgcctggctgatccatttattttttcagattctcagcctggatgtttgatgaagctcaccaagagcctcttttatctgttgtaatttttaactgaggttgactaatctatggtatagagttggagggtgagggtcaaggtaacagtcaatctgggcatcattagttaagtcgtacaaatctttgctattttcaagggttttaagtgagctaaactcctctccaaacatccttgtagatacttgtgggagactgactaattcctttacaaagaagaaaagtcacataacttctttgccttttaattttctttttctccaacatgaaaatatcagcaatattagaaagaggcacatggagtttgcgtgtggtggctcatgcctgtaatcccagcactttgagaggctgaggcaggtggatcatttgaggtcaggaatttgagaccagcctggccaatatggtgaaaccttgtctctactaaaaatagaaaaaatagccgggcgtgttggcgggagcctgtaatcccagctacttgggaggctgaggcaggagaatcacttgaacctgggaggtggaggttacagtgagctgagatcacgccattgcactccagcctgggtgacaaagcaagactctgtctaaaaaaaaagaaaaaaaaaaagaaatatgtaaatggaaaagaacaaacccccctcccaggttccttattccccttggtgcctgggccattgtagatctagcatatgcttggtggggacatctgccatttgctttagggttacactacatctttctactttgagtgcttgaagagttgctccagcagggcctgatgtgggcctggtgaaaatctagcctagttgcctttctgtctgccatagcctgggcattttcctaaggttgggagtttttttccttctggtcttaggccagttgccagaggaaaccgatgactaaaggcttcctccctgcaacgtcaacttctggaacctttcctgatgattcctaccagtcaagtctgccttatttggctattttctcccccctcaagttactccctctccttgccaccccacctcaactagtcctctgttctcctttagtacagggaatgccttcttcaagtttatacaataccacctgcaaacttcttttcttcttgtttagagtcctaatataggggaggagtggggaaggagagaggaagatgggagagctctggaatgactgtgatttctccaccctgctttcttatctccctttatcctcttggcactgcctggtcactcctctacagcttcttacctagatctctgacagcctaggagtggtctcgattggcctaaagaggttcagagtgtgggggtgggatggggctagggctttcagcatttgaaactatttctttggagcaggtaaagccttccagttggtaagtctagttctttaagtatgcctgttgtatgcctagccttctcacttggctttcctgggtgggctgagtctaagttccctctacctccccttcccagtcctgagctgtctaactttaggttagaagagctgagcttttgacacttacagcttggggcacttgtctgggtgtctttaaaaataccttttagtaaaaaatggtacaatggaaagaagagtgagatatttggtttttaatctctgcctgtgtgaccttgggcaagtcacttttatgaggcttaattttcttatctacaaaatagagacattggctttttctgacattctgattatttgtgcccagtctttaagaggctaggaaaggggtcttggaaagcgtgtagcagagcagagtggtgacttttcggagaagcttccttttcccatttagaatggcattgagtgtgtcattttctcctctggctatcaacatgtaagcagccccctctatttcagtgagctctgctctgggatatactgaatctacctaccagagagctcactgtggagattctggcttggagagacaactgttgactacatgccttgggtggggtcttggagtccagcctgcagactacagttgctggctatttttggtcatctgtgactcaggaagaatagaagacccttggattggtcattgttccatcagggaaagggaagacaaagaaacaagctaaaactgaggacatatgagatttcacttcctttactccctcccccacaacatccctttttgtagggctatgaaattgcttttgactgagtcttaaattgctaagctccctttccccttcctctatctgaatcattgttgactatgttgcccttggacggggagagctaggtgatatgggcttgggtggagcaaaagggagaatttctagtcaggaagattgccacacacctagtgttgggctttcaactgatcctgtattttgtaaatatggtttcctttggtattagtcctggagatcaaaggagagggacttctgaattttctgtgagggcctacaaggctgatagggaataagcaagtttatgggaaaggtgtacccttcactggatctgtttttacccatcctctacttcttcctccttttcgtccttctcactgacactttatccagtgcttgcttgtgaaacaaggatcccacattggatctcagccacctaagagttggccatgaacataaaccttacctgctctgagccccctggagaaagcacaagaagtcttggcatctgttttccttcctttagaaacaagttccttgggcatccttgggcagtttaaccagagaagccttagttgggtagtgctgggcagtgctgttagggggaagattcttctccagcattgagctggaatggcctgtgggctatgcaggagcttgctgctggaagcagctgccttgctggaagcttctcattcttcctaggtacctcacatgggttgttagcgatgccagttgtaggtggtggatcaaaatggctgttggtttgggaaggtaggcaagcaggtggaggaagaaggaatgtagagtcaaatggaagaagagtggttctttttttatatttcccctttttttaaaactcagcatggcatatgacaaagtttagcaaatagagagagaaattgtgtataaattcatcattttaacatggcaataattatttgtatttcttgtcgtatctcatatatgtaccttagtttttggtggtgcaatcatagtgtacataaaaaagttctccttctttccccctacttaacacatcactaaaaacttagataaatgctatttaattttaagaaatgaacattctaatggccatgtaaaattctattcaaaggctatgccataatttaaaaccattctcctttgggggagcatttagattactcccagcatttgctagtatagatacattcccatgaatgtgaaaagagaaaattgaaacctcttagcatagcatatagggaggtccctttggtacctcaccccattctagcttcctctcccaactcagctcccatttattcccacatgtatgctatgtggtagctttgtgggcccaaggtttcccaagtccaagtaagctatacccgtcctttttctttttttcatccagctttttcaggttgaatttgttttgttttgttttgtttttttgagacagagtctcactctgttgcccaggctggagtgcagtggtccaatcttggctcactgcaacctccacctcctgggttcaagcgattcttgtgcctcagcctccctagcagctgggattacagggatgtgccaccaaacctggctaatttttgtatttttttagtagagacagggttttaccatgttggccaggctggtcttgaactcctggcctaaagtgatccacccacctcagcctcccaaagtgctgggattacaggtatgagccactgcacctggccatgattttttttttaactgtggaaagcaatgccatacctcttctttctgctttagcctatgttctttccttcagcttgaaatttcaggtgcctcttcttcatctcccccccactccatgtcacttccattggaaactttctttattactcccagatagtattgtactatcttctatgtgcccactgtactttgtaagaacttctgttatgttatttaccatgcagaattgcagccatctgggctcctaggcttgctctttcattaaacgtgtgcatttggaagcttctagctcttcctgtctcaagaaggggccattctccaggtggaggtggttaggaatggacaaacctttgaggagcatttggtcagtaatatacatggtgagggagaagcagtagcaatgaatgcaggggatccaacagtgttggatgagcacctggtagggcatactaaccactagtaatagagaaaatacaccttggagaagggacaggtgtattagcacctatggggaagagaggcctgagtgtaagtacagagaaagcctagctggccttgagtcaccagtgcaaattctgaaaccattccagattttagttccccatctgtggaatggaaagagtaatagcaacctactttttagggttatgctgaggattcattcagtgcactaatgcatctgcaagtggtctgtgaggtgtgaggcacaaaggaaggaaggtaggcccaggacactccagtatgtttgttccagttggccttttaaagttctgtgctatatgtgattccaatcaagcctctgaacccagaatgccagatgctacagtttctctgaaccccacataggtgcccctacagccagttttttattttttttttaagtaggaagtatgcagggaagtaccatctcctcactcatttgagcagcctgactccaactggccctagcacagccctactcaagaatgaccacaagtgcctggggagggaggggccaccatcaccttagctctttagtataaaataagtggtttagagtagagggtttcttaacatccctttagctataggtagaagtgtagaagctgcagtgaaactgagcacctttcaggtcttctggtctgaagcctgccatgtactgtgggaaggacagatcttcatgtctgtcactaactgtatactctttagaggcctgcccatctcatctgtcttaggaaaacagttcatgaagaaccatctaagccaaattcaaggtctttgagtggagaatctcaattaattgctttttgttttcaccacatactacccatggcttcttttgttgtttttattgttgttgttgggacccttggcttcttgctgctgccttggccatttgcatacccccattccaccccaggactttatgttttgtaaggaagcaaattacctgagccagtggaagatctactggtcacctataaatcaacacgaagaagggacttgctcaaggtcatgtattgaggcagaagcagaaactggtattgaaggcaagactctcaggagtgtgttctttccattatgtcagtctagcccactagtgtgtaagcttcatgagaacagagatggtttctcaccacccattatatccccggtacccaacacaatgatgcctggcataaagtagattctcaacaaatatttattgaatagatatgttaatagctactattttcatgttggaactgtcttctttagattcctttagctagatctaccagatagccaaacaacaattccattgatccactggaaactacctaatgtggacccagctgggccctggcagaatggaacagggtagcaccggggaatgggaaggcattgtctctcttgtgcaccttggagagactgtttatctgtgagtggccagcatgttcatagccatttctgctcccttttcccatatcttcacataatacagtagtgttcgtgtcaagtgggaatattcaaatcaaaactttttgtggattctaacaggcagccatgcaaacatttctgtccacctttgtgaagtagcccaaagtttggctgtacagtacatatttgagacattactcaatttttaatttttttgtgtttgtgctgctcattatggcatggccagcaggcagggctgcattgcataatttaatcctgagaggtttgtgcacctgaggtttagggatttggttggcccctgtgctgaggcctaggaagagacaggcatagaccagggaggatagcaaggaagtcctggcgatcataatgttggggcatccagtggatatccactcttgctattgctactgttgccgccgccgccaccaccaccaccaccaccaccaccaccaccaccaccaccaccaccacccaggctgctttagggcccagagctgcttatctttgcagacttggtattttttggccaaggtagactaattttgggggcagtaggagatattttcctcccatccactcctgagaaaagggtagggccagcatttgagaggtgtaggtttatgcttactaggtaaggttgactgtcctaaaatagagagagcttctgaagttcacctagtctttaaaggacttttcccatctgtttttttagtcctgagccatataaggaaagttaacagacacaatctctgctgtgtggtggaacagatttaaataaatacagactttgttttacaattttggattaatttttcattatgaaactaaacatgtttgttgtaagaaatgaaacagcattgaaaaatataaagcctcctgtcttctgcccctgactgtattctccagagacaaccatcattaaccagttagttatgtgaacataaactcttttttttctttctttctttttcttttttttttttttttgagatggagtcttgctctgttgcccaggctggagtgcagtgatgcgatcttggctcactgcaacctccgcctcccaggttcaagtgattctcatgcctcagtctcccgagtagctggggttataggtgcctgccaccatgtccagctaattttttctatttttagtagaaatgtggtcttgccatgttggccagcctggtcttgaactcctgacctcaggtgatccacctgcctcggcctcccaaagtgcggggattacaggcatgagccactgcgcccagcccatagactcttttttcatgcatttgtatatatatgcctttaaatgcacagatagtacaaatccgtattgttctgcttttttaacttagtatgtgctggccatcttttaatgtcaaatccgattttaaagtctacaggggctcattaataagcaaatcagcaaataggtagaacactttttaaacattaaaatcttttttttcttttttttttttgaggcagagttttgctctttttgcccaggctggagtgcaatggcgcgatctcggctcactgcaacctctgcctcccgggttcaagctattctcctgcctcggcctcccgagtaactgggattacaggcacatgccaccacgccagactaattttgtatttttagtagagatggggtttcatcatgttggtcaggctggtctcgaactcctgacctccagtaatccacccgcctcggcctcccaaagtgctgggattataagcgtaagccactgtgcctggccaaaaaagcttttttatatagagacagcgtctcactctgttacccaggccggagtgcagtggtgtgatcatagcacactgtaacctccaactcttgggcttaagcagtcctcctgtctcagccccctgagtggctaagactacaggtgcattctaccatgcccagttatttttctattttttgtatggacagggtactagctatgttgcccaggctagtcttgagctcctgggctcaagcaatcctatcacctcagcctcccaaagtgttgggattaaaggcgtgagccaccaatgcctggatgaattggtggaacacttaaaatctacacaaataaaggggccatactcttcattaagtggaaaataaagaagttgtaatgaggatttgtctgtctgagagggaaggttttctgaagatgtgatatgtgaacccttctgttgcgatgaaagatgatggtagctgctcccctttctatgctcagtaggccccacctatagagattgctttagatcctgtgtctaaatgagctcagtggagtgattagtggtaggataaacttattttctatgcttagcatggtccccttcctgttttgtggttttgccagcttggggtggtttgattccagacagtacctgactgagaatcctgcacctcagaagacctctggctgttggagctgtctgaggtgaaggaaagaaactttgtgagtgtacatatgtgtgtgtttgtgataggcacatgcttttccaatgttctccacagaagagcagtggaggctggtccgatggtagtgggttaccgatggtactgggttgtcagaacttgttaacattagcatcactgaagtttttgtttttgtttttgtttttttgagacagagtcttgctctgtcacccaggttggagtgcagtggtatgatcttggctcacggtagcctccaccttccaggttcaagcagttctcatgcctcagcctcccaagtataggcgtgcaccactgtgcctggccaattttaatatttttagtagagacaggtttttgccgtgttggccaggctggtcttgaactgttggcttcaagcaatcttcctgccttgacctcccaaagtgttgggattgcaggcgtgagccaccacgcctcagccactgaagtgggtgtacaaccccccactgctaaatttgactggcttaaaaacaaacaaacaaacaaacaaagaagagctgtggaagggcctgtcaattatcagagaagctagattagaatccccttcctaacaacatacacatcaggaatcttgtccaggtggtaggaaagtggaattttgcagagcactcagctgtaggtgagccaccagttgaataattgaggaagatagtgatttgtgaaatacaaatattttgaaagaaaaattctagcctagtggtcactggtcctggtcttagaagctttctaacttgagagtattgattatgttgaaggaaccaggccactagaggagaagcagaattaccagaaatgctggctctattctgcccactcatggcaggccccacctttctcttgcctttttattcccagacttccacagttggtggggcagagttctgcttgcccagcctttaatcctggaacctctgctaccagaggttgaccctgactgggctaggcccacaggccactgcaggcattattcccttccccttcagacaaacaggaagctgcctgcacactcttagtgattggcactttcaggagctttgtgaggcagggagtttgagatcaggttccaaaaggaaaaggaaatgacattttaaataattttttgggctacttgagaaggtgtggatccaaagtatctccaggcatttattgtaggccaggcttgcaggaatatctgtgtttccatacttacttgctgtttgaccttggagaaatcccttaacctccctgagcctccacttctcccgttggtaaagtgggaatgattatgtgttaacctcagaattggtgggaaacttggataagttagcagtggaaggctctgaaatgttagctcgtagaaaatcaagtgttcaggattcaggtgctcagagaagtttaaatcatgttttaatagtctctgttgacaaaagcagtagagtatatcagtagatgaaagactttcagctcaccactaagaatagttatgatccttaaacgggtgagcctcagttatcagaaaatgttcacttctgtgatacagctcatttatagaccatttaggaccaatgaggcattgccatataatcatctctcaaccatccataataaaactctcttctcggccaggcgtggtggctcatgcctataatcccagcactttgggaggctgaggcgggtggatcacgaggtcaggagtttgagaccagcctgaccaacatggtgaaaccccgtctctactaaaaatactaaaaaaattagctgggtgtggtggcgagtgcttataatcccagctactcaggaggctgaggcaggagaatcgcttgaatctgggaggcagaggttgcagtgagctgagattgagccactgcactccagcctgggtgacagagcgagactctctcaaaaaacaaacaaacacacaaacaaacaaacaaaaaaatcccctctcttctcagctacctgtggactgcctgttctaaataatgtgagctcagggaatacaggctcttctgataatccaaataacacataattagttatgcaaacgtgtcctaaaagtttccagggtgaagtggttaggttgctgttgctgagtaatccatagagtattactcttatgttgatgtgggtaactgaccttaactataaggaaaatggtgaactttgcactctggagcaaggaaagtgataggcttctacttctcaggtcatttgtgccttcactgaccatccctccagctgtgaactcaggtagaggcagcatatttatgagaatcggattagaaaggaggcaatccttcaaagatcggaggttgagaagacatgtttgagtgtgccctgcatggacttttattccagggagagtcgagtagttctcccttcatcacactctactgagattgtcctttggcaagaagaaccaagcttaaagaaaatcttaaaagagccattaggaacctcttggggcaagttcttctggaacctctagctgcttaacatcccagaaaaagaaattctagggttaggaagctggaaaggatttataattttaggggatagctgcccattttccaaatagttttctgtttaaaatagccaagtcagatgcgaattgaaggaatctcttgacaggttggctggcattgccctgtaatttttttccagtgtccaagtaatgataattctctatatttgtaacaagtttcatagttgtaaaactcttttttattgttattactatgtcatttgatattcatcaactctctacagttggcaggttaggaattattatcttttttaaaattattttttaaaatagagacagggtttcactgtgttggccagcctagtcgcgaactcctgggctcaagagatccgcccacttcggcctctcaaagtgctgggattacaggtgtgagccaacacacccagccaggaattattatctttacttttacataagggaaaactggggctcatagactttaagtggctgcaaaaattactcagctaatgagtaatggagacaaggcttgattgggagacagaagactttggttttcgactatgcacggggtggagtgtgggaagggaaggcagtgttgtttcataaaggcctggacttaagctctggtcatggttaggtcagagttctgaagctagaaaggaagtttcagctttaaacatttggcccttcccccgttccagtggttgcccaacctcttttcagtctctcttctaaatattgtaagtcaagactaatgtttagagagagagcacttgggggctgtgtggggatggccacctgttatatttgtgtcctgcctacttggggcctggcctgactctggttttgcaactggcttcctgtgtaacccattcttggtagtgtcagaccactgccttcaaggctaattgtgctttccacctggttgagccaataacttattttgttttgccatgctcctggacatatgggagttgcttattagtaggtgagaattgtttgggggctgcttagacctagctaatgtagagtcttgtttgtaccttggtgggagcaagagcatcaatccaactttttgttgagaggaagaggtattggagaatcatggaaaaggcactcttttttagttgaagagctgttgtttatgctgggccttgctgttagctttccagagcaatcttgaccaagtccttgctcgtttttgggccatagcctgttccacaagaggttggtttggctaacctctgagggctatttcctgctctgaaactctgatttattcagaaatgttatactcccctaacaatggaggctggtctgccctcccatgggtacgggaatggtggcacacatctcagaaatggttttgttctgtgcggaactgagccaaatggacaactctaccagctccaaaaagttggaagtggtcagctgtgtctgaattttgtaagggagcataactgggtggaggggtgaacaggcatcattagaggccggatgtggatgaggagggaagaagtgccctggagaggtagttcatagagaacccaccagaaacaggtgataagctgacatcatgaggtagatggtttatcccagtctgtggccaggtagttcctggtcacaagcagttggtacgccctcaggaatgtgataccatcacatgggaatgtgtcactagagcagccaaaaggctgtggatgcaggaagagcagctctctcttgtcaccattccctctgtgaagggtgggagattcttaaaattgggccatagagaccatatgtggcaaatgaaaaaaacaattcacaatggcagataggactggtcctttagagaaaggaaaagttgtaatgcttgcctgatgtcaaagcatgtggggttggatttgctagttccaatacattttaattttttttcttgtggacttgaagcaaggtttggaaaaagggggaaatttgaactcatgacctttggaaaccagaatgaagcttaatgttgactgttagagctgcccttcttatagtagggggctgagttttgcatggagccatctaggctccctgccttctgatctaccttggccagggtgtacctggggaagtccagcttgcctgtgtaattgatcttgaccagtttgtaggagcacgtgtagactctgattaattggtttgggttaaggctttgggaatcaatattttctgagcactcccacagggaattctaacattgggcaaaggttgattactgcatctctaatagaagcctctccttgctacatgtgacaaaactgaaccagagaaaggggagggaggcctgtgcccatgtcaatatggcatggatacagctgatctgagcactgagctaatgctttttccagggctctttggactcttctaacagttcaattggacatcctctaaacttggtcagaggtccagaaggagatagtagttatggcccccaacccaaaagtgctggaggaaggggtggggttaactaattgcacccaagggaggtgagcagccctttttagagagtgagttcaccgtctgggcgtgagcagaccagtggttgggggaaaggggaaggatagaacaggataggaggtgagtaatgctgtgggcatcaagacattcagttagtgggaacattatagggagctggtgagctcaaggacctggtgacttcactcctcagatccatgtggacttgcagggctggagccctgtctcagtgtccaagacgtgtgtcttgtgcctgggaactgaggactgcttgttctctgcttcctgcttcagctggatggcctttacgcttgattagggagtgagcccagccatagagcagcctctccttggccccagcccctactgctactatcctttcagagtggatcaagctctcgcgcatattggggcacactgtatcacagtgtggtctttgattatttttccactgttttacatgtagtatcccgagtagagaataagctccttctatggtaggaaagggggctttgttccaagtccttcctaggggcatgggaaggtgcttaatggagagaagcaagcagcatgagtaggacactttgggtttcttttctctcgccagtatcaaaaggaacttttcttaggagagaaaggtaactgggagctttagggtggatatagtacacacttcattctctggggtccaagaattatgtctttttcctactaggtggggaaccccttgaagtagtacttggcatagtctctgtattcccagtgcagagtaaaataccccacactttgcaggggttcaatagctgctgaattggtttaagggcattttttgtcttatcctctcccttgagtcagattagattccccagaagccccctatctcctggctgaagactatggaagctaacaggggaggaaaggaagggctgcatccacagttggctgtctggcacctcttggatccagaaatccacctataattcttagcagtagttaacttttcaggtgtatatactttcacatgtagatgttttttatttctttttgtttcttttcctttttttttgagatggagttttgctcttgttgcccaggctggagtgcaatggtgcaatctcgacttactgcaactttcgcctcctgggttcaagtgattatgctgcctcagcctcccgagtagctgggattccaggtgcccgcctccacgcctggttaattttttgtatttttagtagagatggggtttcaccatgttggccaggctggtcttgaacacctggccttaggtaatccacccacctcagcctcccaaagtgttgggattacaggcgtgagccactgttcccggctcttttctttttctagaggaggaacaattgtgaagagccagggtgggaggttagaaggtaggcactcctgaatggttgtttcttcccaccacttttgagagaagggccaagcagatcatgaacatcctagacttagtccagaggagaaaggccttagtgtagtgttggccactaatggaggtcattagccgtggagctctgtggtggccttctttcattcttagcctctcactcccattgagtttggcatccttagcttgatttccttttattctccaaaccttttctgagggaatagggagagaagcaaggcacacatgttcctttgcttcttgagcccttaattggccagctgggagggatccccttcttgcttctttcttcttcatgcatgcctgttgctctctaaggtcagggatttgagccagaggcctgggagtcaggtactttatggctcagcccctggcctggggcctcctattgtggggatcagcttggcccagggccttcctagtatgagaatggaatgagcttttgtggaagatggttagtggtctaagcttattatctattttttctgccagtgcctttgcataggaagggagtaggctgctatgtatgatcaattggtatgtgggccagttatctttggctaactttcagataaaacctttgctgtccatcttttttggaaagtagaatgtgaaaagagatatttatccaggtttgaggccttgcagatagtcagtggagttatcagtatttggttaagtctaggaattggtgaacttgcctgttggaccagtttttgtatgtatcataaaaataagttttaccattttaaaaacattttttgtttgtttgttggtttttgtttgttttgttttgttttcagacggagttttgctcttgttgcccaggctggagtgcagtggcatgatctcggctcactgcaacttctgcctcccaggttcaagcgattctcctgcctcagcctcctgaatagctgggattacaggcgcccaccaccactcctagctaatttttgtatttttagtagatacgaggtttcgccatattggctaggctggtctcgaactcctggcctcaggtgatcctcccacctcggccagcgttgtttttttaaaaaagaaaaaagaatatgtaaccaagactataagtggcttacagagacagtttgccaatctctgctagtctgtgctttagactgccaatttattgtatacctatttcttatatactcatggcttctttatagtcacctctttcctgatccagacacactgcaggcctttgaatcctgcttcttgtagccaatcataaataccttccatgttggttactaactaaccaaaccattgtgtctccttccatgtatacatggggtctgtggtcacctagggttagaattaaaattgtacttttcaaaaaatcagctcctgggttcattgattttttgaagggttttttgtgtctctatctccttcagttctgcactgatcttagttatttcttgccttctgctagcttttgatgtgtttgctcttgcttctctagttcttttaattgtgatgttagggtgtcaattttagatctttcctgctttctcttgtgggcatttagtgctataaatttccctttagggactaaagaatatttatgagtagtcaatgagtgaggttggcttaaatggttttcaggtgataattaatggtgagcatcctaagtagagttgcctcaggtcttcctgcgatttttttggggggcctagagtctcatcaacattgctcaagttgattcaagagaaaggagggtggtagttataagataaatgacagaccaaatattagaatcattttaaccattatttattgctgcatgactttgggtaatgtatttaatgtctctcaaccttagtttccccatctttaaaatggaggatagtgggccgggcgcagtggctcacgcctgtaatcccagcactttgggaggccgaggcgggcagatcacgaggtcaggagatccagaccatcctggctaacacggtgaaaccccgtctctactaaaaatacaaaaaattagccgggcatggtggcatgtgcctgtattcccagctattcgggaggctgaggcaggagaatcgcttgaacccaggaggcggaggttgcagtgagccaagatcgcaccactgcactacagcctgggtgacagagcaagactccatctcaaacaaacacacaaacaaaaaacaaaaaaaaaaaacaaaacggaggatagtactgatacctacttcactgagatttatgagagttaaaagagctcaagagtatgagtatatctaggagagtacctggcatattgaaagtgcttgataaatggctgagttccctaagtcttttccatcatactttgccctctttaaggatttgagatcaaataattttagaaccctgaagtctgcttttaatttgtgagtgtgcctcctatactacattatctctttaagatttttttttttttttgagacggagtctctgtctgtcgcccaggctggaatgcagtggcacgatctccgctcactgcagcctttgcctcccaggttccagcgattccctgtctcagcctcccgaggagctgggactagaggcatgcaccaccacgcccggctaatttttgtattttagtagagatggggtttcaccatgttgtccaggctagttctggaactcctggcctcaagtaatccacccgcctcagcctccaaaagtgctgggattacaggcgtgagccaccacgcccggcactctttacggttttgttttaatagatgaggaaactgatacttcaaacagtgatgccaatgactggcctagtttgtggtgaaacccatcgtgccttctgctgcaatctgttggagggaacggttgtctgagaatccatgtgggtgtatctatcactttgtaaagaggaactccagctctgggaagccttaaaagtcccaggatgagggagtagtagaaaaggagaagagggacatgagacccagggtagaaaggatggttatggggtgtgaagaatggaggatgtaggaaggagaaaatgattagaggaatccttacttaagaaggcaaaacagtttgtgaaatcaatggatctccacccctttgcagaagccaggcagccttggctggggcccacctcaggcccttgttatgctggtagctttcacttcttctttgtgtgtgtgtgtgtctgcgtgtgtgtgtgtgtgtgtgtgtgtgtgtggtggtggtggtggtggagtatagatgcagagggatcttagtttggttgcctttccaggtctatctgtaggtaggcaggttatccatgtgtattgaaagtatgttgtcgggccgggcgtgttggctcacgcctgtaatcccagcactttgggaggctgaggtgggtggataacctgaggtcaggagttcgagaccagcctgatcaacatggtgaaaccccgtctctactaaaaatacaaaattagccatgcgtggtggcacatgcctgtgatcccagctacttgggttgctgaggcatgagaatagcttgaacctgggaggtggaagttgcagttagccgagatcatgagatcgtgccattgcactccaggctgggctacaagacaaaactctgtctcaaaaaaaaaaaaaaaaaaaaaaaaaaacaaagaaagaaagtatgttgtcatgggctccctcaagtcctgaagagtgattcctctgaggtctgtgtgagctagggtggggagtgctcattaagctaagctggtgcctcagtggggctgtgggaacataatcagcttcttatctttattttatacattagtctatcttgcctggctttgtcttcagggatttctgtctctgattgtggcccatctcccccaaatctatgagctggcacctaatgccaaagtggtgggaagatctttaattcattttcttctgataaattctgggaagagggtcaggaagctgggaaaggagacactgatatttaacttcatgcctttgagagaaaggcatactttgtgtttcttacctctgtatccctgtacatgctgtctctctacccagaataccatgaggttccttttccctttaatctttttcttgtgacagtctcctttgtccttcaggagaggtcagctctatctcaagcaaccttctgccttctcacctccccttgtctcctcaccttccccattatggcctggatgcctcttgcttgtgtttccacagtccactttaattacctctatctctgcccttgctgtatagaatggtaatttctcatccatttatctgcatatttcctccatctgacaaaaaaatgccctcacgtgcttgctcattcacacacacacacacacacacacacacgaattatttcaaagcctgatccgatccatattgggtgtctgataaagtggtggtatgtagaacctgtatgtgtatacatatgtctgtgtcaatgatgtgggttctttctgaaacacctgaggtaggtaagaggtagccttacttgtttttccagatcttgctagaatagtagatttttagggtttgctttggattatggaacaatgtatgttgccttgaccattagggaggcttctgggtaatttccatagagattctggttggcctctttactgttgtctgaaaaaactagaccaaacattcggggctgggggtaggattcttattctctccaaagaactgatatgaatatgtgtgtggggggctagataggttcatgctcgctcacctcagcattgaggggtgtgaaggttatatgtttgtggtggtaggggtgctaaaaacccttgtattattgcaggataggttaaatagtttttactagtctcagtaaattgttagctgagcttgtggtttggagggaaagatgtggctttatcaactcgaaaaaacaaagccagcttttagagaagttacctcaagctacatagggaccaaaactaataagctggatgccatgtggtctcttatcttatccttgccaccaagagactcttccaaaacaatcatagatccatacagcccaagagcattctttgggctctctgaacctctgcttccaggaaggcggtcatacaaaaatgaaggctgtgagctaatggctgtaaacaaatacacttgcagcaggttatgaggccacctttcaaccttcagcacatccactggaggtaggtatttttgagactactctcaaaaaattttttcttaaggcctacgtgataaaccttgttccctaatggggatgagaattggattaggctgtaagattagcctaggggaacagcaggctgggtggggggttggggacatcctgcttaggggtagccagccaaagtcccccatacaagcccaaccaaggatcatgccacattgaaggtctgcacagtagtgaggcagtgctgtggaatgacatctgccttccaacttcttacgtgagtaaggaggctctccctgaatattcagatggatgttcagccacattctttgctatatttatagggtggggagggaagacaagggggagccagggagtccgagctgtttagagaggagagaaggaagtttcaacaatgggtaggttcaggctgtggttcctcctcactgccccttcctctttgagtttgtcaggggaccttcctatggcctgagatcattttctttttcaaagtggccaaagccactgtaggcacatttaaatcagggtgctttagcagaaataccaatgctggcatctaaaacccatgtgtagtgagacttgattgacatttgggacctttttaaaactgtaattttattgtatttttgcatttcctggtttgttaatcaaggaagaacattggcatgtcatcttccagtctccaaatgtaagttaaattgtcaatttgtgtttttccagaaaatttctttttccagaagtgctttgaatcatgatcatctatctgtaggcatggatcctccaatttagaagttgctcctagtgttacctagttacccttcctgttccattctgtgaaactgggagatttactgtagattattcagtctggtcagacagaaaactgcagctccctccccagtcaaccaaagcctcctctatggaggggaggtatggtaatgacattatctttccttaggcagccgcgtgttctctgagaacaggatgtggggagggctgggccccagtcacagggtatgggggtgggcaccggaaaatgggctggtggtaaggccatgaggattagtgcttgccttcttggctttgagaggcatgaagagctcctgtattcttgattgttcactcatgtgtacaccccaccctcgcacatggcatgtctgtgttcttaccctaagaaagactgtacctgagaaacaccttgtgtaagagccccagctgtttggcttgcagaaactcagtgaggtggagtgagtgggcccaggctgctcactgtaccaacccatgccttgtgattctttatgacagcctgtggcttcaggccacttttgctaagctttattggggagctgggccccagtagataatgggcagctttgctgctctttctcagggccccagttgtttccctccccacaaatggctccttagctgaggtgatttgcatgttcaacttcctttcaggccccatccttctcttctccctgccccccactgcttctgctggggacctgtggtgatgttctgcctggggtggggaaaagaggatgtagctagcttcctgtgcaaaagagggtggggcgccggccttcctgcctgtctgcccacccacccagtgcttgaggaattgcctgaagagttcagttcagagtcaccagagcctgaagggctttcttcagagtagagattgacctttgctcatgctggtctctctccacagttttctactgtgggaatagctggacacttttttcctgaaatcgcaatgctgaaaggacctttagaggccaactagaccaaccacttcacattacagatggggaaactgaagcccagaaagtcatataagtcctataaggaatcagtggcaaagctaggatgagtagaattctagaaggtcagacctagggctctctccctcccgtcaagctgctaatccagtgggttacaaactgtttggctgggctacctggtgagctacagcctcccttcaaccagaacagctctacttttacgtacttcatattttgaagttttgtgtgattttctgtttgggagattgaggaggcaggaagctgttagaaatgtaataaagtcaaaaccactgagcaaaacccagccattacagttgggaacactcagacctacagggggaagtaaatatccgaagtttactgggattggactcagagacccaatctctgaaccaccattcatggctggttgctccgagctaaagatgtggctccttctaccacaagggctgttcccaccctgtgttaccaatgctattctcctttcccaaagacagcctcttttgtagcatcctaagacagacctgaagtccagaggctgctcaatttcttggatgaaacaaatgataagccaggagcggtggctcacgcctgtaatcccagcactttgggaggccgaggcgggtggatcacgaggtcgggagatcgagaccatcctggctaacacagtgaaacaccgtctctactaaaaataaaaaaaaatagctgggtgtggtggtgggcgcctgtagtcccagctactcggaaggctgaggcaggagaatggcgtgaacccaggaggcggagcttgcagtgagccgagatggtgccactgcactccagcctgggcaacagagcgagaatctgtttcaaaaaaaaaaaaaaaaaaaaaaagacaaatgataataggcaagcctttggaaggacctttgtgtagccttaaataagataaacttggaaaggtaaagaacagaatactagtagttggggagatcagggttctagttctatttctttcacacttgagcatgttgctttttaccttactgaacctccatttctcccttctttaaaatggtacttgtctcgggcttgtctttttcttacagggtttaattcagtgagagaatgcatatgggcaagtatcttttaaattgtagagcactgtgcgcatggggctaggattattgttgtatacaagtgagccagagaccctggaagaatctgggttggataatggcattgcaggagaaaggaactaaaatttatgaaacatctactacatgccaggtaccaagccaggtgcttttctgtttgtaaaggataaaatgtcagccttgcaacactccggtgaggtaggcattattactcccattttacctgtaggaaaactgaggctttaagaggtctagggacttgtaatgttccagagactacctctagagcccagggtttctgtcaggtatttgtgaagagatcttaagaatgtcctatggtttctattggggttttctagcccactccctgcctcactccagcctctctcctctggtggggatgagactgtctcttgttggcttcatgtctcagtcctgaactctttatcctcagatttccttggagtgcactgggcacaattaggtgcccttgtttggcctttagctgatggggagccctttgggtcagccaccttttggctgatagtaaggatgtcctgctaccctggggtgctggtaaggagagccagggatttatagctagccagacagacttggctcttggtcaaggtcatgcagctagaaaatagcagttggttcctttctttgagactcagtttcctcattcataaaatgggtttaataatgcttaacttgcatgtgtctcttgtccagtgtgctggtaaatgtttaacaatcaactcttcggcaaatccatgatttttactgtttgccaattcccatggtataaatactcccaccatggctgatttcaggttaccaatatgcagtccttgatggaggagttgggaagagatgtgcatgatcagctctagtgcaagctggttctagtgcaccattgctagtcacacctattttagactcctaccctcaccctccaacatactcacatctgtatgcaaatgcagcatcctctcaaccatgcctcttcttttcctcaagttccaagagcatcaaggaaagagagagcttcatttaaggtctgctccttgcctgaaagttcttccaggaaagagtgaatgtggagtgtttaagacgcagagaactcaagagggctttgagtggggccctaattatagcattgtgatcatcatgctttggctgctgaagtatctgaactgtctgttttctcccactgtttgattcttagctagatgggaggatggttgaagatcctggacaatggtctgagggtctggtgcacttagcgttctgattgtaatttcaaagtctcctcctcttcctgcctgcagaccttactttgctgggtgctaacctcaaggttcctgtcatggggatctctgggccagaaagcattttggatgaccagagatccctggtcctgttctctcatttcaacagcatcaaggccatgtgttgtttctttgaacttttcagatggaaagaatcacctgaggcatttgttaaaatgctaattccccagcgtcttctctggagagtccatttcagtaagcttggggtggtgtccagaagtctggactttttgaccagtgccaaattcttatggtaagctaagtttgggatatacctcattaagcactgcacaacactcctgccatggtggcatcattatgcccacgttacaagttgaaatttaagagttcatggtttattattggtagacctggatcttgagatcaggttttcagaatacaaagctatgttcctcttactacagagacattactttagtgcacagtggtgtatgtgatggtgtgtagtgatgattttaggtagggaggagcagggataatccctgcactactttacaaatagggaggccaaggtgcagagggatttgagggcagtagcagaactgactgcatccttgcatccttgatcttttgtggatgtggaccgtattcaattggcttttttttttttttttgagacggagtcttcctctgtcgcctgtcgcccatgctgcaggacagtggtgcaatctcggctcactgcaacctctgcctcccgggttcaagcgattctccttcctcagcctcccaagtagctgggactacaagaatgcaccgctacacctggctaatttttgtatttttagtagagacggggtttcaccatgttggccaggctggtcttgaactcctggcctcaagtgatctgcccgccttggcctcccaaagtgttgggattacaggcgtgagccaccgcacccggcctttcagttgctctttacttgctgtgtttcccttctatcagacatccctctagtcatattaacaccatcccaggccaggcgtggtggctcacgcctgtaatcgcagcactttgggaggcaaaggcggtcgaatcacttaaggccaggagttcaagaccagcctggacaacagggtgaaaccccttctctactaaaaatacaaaaattagccagacatagtggtgggtgcctgtaattgcagctacttgggaggctgaagcaggggaattgcttgaacccgggagacgggggttgcagtgagccaagatcacgccattgcactccagcctgggtgacagagtgagactctgtctaaaacaaaacaaaacaaaacaaaacaaaaacagtttgtgatcttctggataccatctgagggagtttggaggtcccagtgggttgtgttgagggttgcagacttgtgtgtgttaatgggacataactggagaaaatggcaaggcagagtccagaataaggaaggaagatcaggcagcctttgaaaataataaggcagcataggtgctgtgttgtgctctgcctttccataggattctgcttcttggggaggaaatccccatctctctcaagagataaaatatttaaaataatgctggaatacatgtgtatttaactgttgtgcatggtttcacattgtcttgccaactagaaatgtaatcaccttttagttttccctgaaagtgagagtcctttatgctagaagggctctttagaggtcttcttgggcagcccctagccctctgtagtgaaacaggtttttgttttaaattattcctgacaggtaggatattcgtcataatatggctaaaaggggagggattagtaatcatcacattctacttatgatgtgtcaagtactttcatgtctattattattattatttttatttttattactgttcaattattttcttcctccagtgtcaaacatgtctgttatgttaacttaaatctcccaataaccctgtactgaggtcgatattattagacccgttttatagattaggaaactgaattttagaaagaggaaggtcaaaaaggctccaaagctcaaaatgctgagaccattatttccaggacaagggctcctgggttttctgtgggtttcccagatactagatttggttcttagcttaccagcaaggtaggtaggaagccaaccttagcctacccctggggttgaaaacagaggttttttgttttttgtttttttttgacaggatctctctctgttgcacaggatagagtgcagtggcaagattttggctcactgcaacctctgcctcctgtgttgaagcaagcgattctcatgcctcagcctcctaagtaagtattagtagctgggactacaggcgtgcgccaccatgcccagctaatttttgtactttttgtagagacagaatttcgccattttgcccaggctggtctttaactgggctcaagcggtctgcttgcctcaccctcccaaagtgctgggattacaggcatgagccaccacgctcagctggaaacagagctttttgattagggccagaagcgtccccctgcaactgcatatttgactaatcctggcttcagcagttttaacattcccatgagcaatagatggaacccaagtttgggtttggatcagctccagtgtgcttcagaagtatgatgctggaggttgctggagtctgttcctaagcagagggaatagagccctcttctggcaccctgggcagagctggcatattcaggcagccaaaaatggtcagtttccagtctacaaatacttcctgtaaaacttgctggcaggaagctgggtcaagcaggaaagtgacgctaaagagtgaagcccagctaggtgtggccccggataggggctttgcccatctggagacttactttattaatgatgggtctgcacttcttttatttcagcagctttgaagttttatgggagttgaaggaatctgttgttcttggctgcctggatatgaacccattactcaaattcccttcctctttctctgctctgtgccctcctcaatccccagcttgagtcttggctatgcctattactgggggccttcccaaccagttgctattcaagtttttccaaagaaaacagttctggaaacagggctctctgagttctccttccatggtgttataaaatatttagtctccctagaatgggtggtggtgattgtctcagatcctgaaagttaggcctgccctctgttgaaagctaaacttccaagcagtgccagcttggagtttttcacggaaacaaattgatccagcctcctccacatagttttttttttagatcaataatagtatgcttgaagtatctactgttttctaaatgtcaggctggcactatggcttactaaataggctagtggatcaaaagccaggttttttttttttttttgagatggagtcttgctccgtcacccaggctggagtgcagtggcgcaatcttggctcactgcaatctccgcttcccgggttcaagcaattttcctgtctcagccgccctagtagctgggacaacaggcacacaacaccatgcctggctaattttttgtatttttaggagaaacaggatgtcaccatattggtcaggctggtctcgaactcctgacctcaggtgatcctcccaccttggcctcccaaagtgctgggattacaagtgtgagccaccgcgcccagcctcaaaagccaggtttttagcccctcctcccacactgcctagcagctgtgtggctctgggccagtgcctacctttctttggacctcagtttccccagctgtatgttgcaaggttcgaatcgagtgatctctgacgtctttttcaggtctgacagtttgggattctggactgtttattttcttagaggacaagttgaagttcagaagggagaagccatatgagattctaggatgcatgggttgaaataatgagaaaatgtaaaaagaggaatggccatgctaaggagctggtgtgtcagcccatgtgcctaagaaggagagatgagttggggctggagagtatttgccctgggggtatggtttggctaaggtgattttgaaagtaagaactgaagttaggttcagacactaagcagatggttttcttcctgactttcacgtgtggagagaaaaacaagaggggtttacctgggcctgaggttgaacaaaaggccatgcaattacggctggattaacgaagaaactaacttgctaaagtgacatcactgtttctgatttttttctttcaattttcacctctgacctgaactctgctcccacagggacaaggtggttatatttccattgctaaccctcacacatatggtaattggaggagtaactctcagtttccagtgtgcccttgtcttccagttgaaatgcttcttgaggagcttcggatgacagggctgggtcaaaacaaatgaaaggggacccttgtctctgacgccctctggagcagttggagtggttgaagaaatactgctaacccattaaggtgtgagtgaggttgggtgttgttctcctttctagaagctactgggaaaaggcacaggcataggaaaggttaaccccagtcaggttttatgggctgtattgagagtctggaagaggtcctagcagataactgtaccagttaccacttccaagtcaacagggaagaggctgacttgctgagaagtgagttagtcagtgaaggaagaggaggaggagcagaatggcccctaggctaaagattcaaagcaaaccttgttttccctcttatggaaaaaagctagttgagacagtgctgtcatccagagaggcaaaacagaccaggacctgccctgccctgccttggccccactcttagtagcaggaaatggtgggaactggagcctaaacaatggagtttagcttccgacctgatgaaggcagtgtgagtgacgctgtgatgactattctctggccaaggaagatactagaactctgggattgcgttggtagggcacatccttcttctggctcccctgccccacttatacttgccttcttctctacaccagcagccccactgaaagcccagcaggggtggccccctggggaggtggcaggtggaaatgaggtcattgagctcagacccaactgggctgactcacaacctctgccccagtgagacaaggggaccttcccaagcagtgcttcccagatgtgcccaggcttcctatgccagaatgtttgagtcttagccaaaatagttgccaagccagtgtctgaagacaacatgacaggagaggtgggtggagttgtggaaggagctccaggaatgtccagaagacccgcctccactacttgttggctgagtaaatgtgacctcagtgatgttaagtgagactgtgtgtgatgaggccgacacattgttggcattcagtaagtgttcatttccatccttctgtcacctgcctctatgcacttcagttttctcatctatgaagtggggatggtaatgttcatcccctcagctcggaggtccatgctccaggcaagttacttgtaattatttgacttactctctgcttttctctctgactcttccaaacttctctccaggaaagagccatcttatagttcagtgacatggggtaggtgaggggaaaccattgctaatcccttttgctgtagctgggctacagctcacctgggtgcttctgatgataggcaaagagagggttgcttatttgaaactggcaggcccagacaccaaagtacctctcagctgctggtgccaagacagaggtagcatctggcctggttacttttgtgtctcagcccagctaactggagacatgagagagaacccagtttgttgaaggctttggacagtgtaccaccgagatgagtttgtttgtgcttagtgaagtgcttggtgtgggaagcgtctatgttgaattgctcagtaaataacagtgggcttattgttcttgggcaacaggtgggagggccagtgcatgtgagaggatgacactcctccttccccaaacacacatgcagacattttgttattgttccttcaaaccttaatgttcttctgagacacagtctttaacctcatgctgtgcctagatcctcagggcctggcttaggcagggatctaggcatataaacagttctcttctggggactacatcttgaaatgctaccccatccgggtcagctcctgtattcctgtcaaactgaaggactggctgggaattttctgccaactttggaaacttcatttttaggttctttcctcccaaacaagaccactgtcttctctttagggagagagcagcgtctaggcccgaaaagaagaccatgggtgcctactaagggtgagcatccagtgggccctctgtggcagtgggtctgggcctgcagcccatcttgcactcttgaatccctgattaatctaagagagaacaaagggaccttctttgatcaggacttctatcctatctatcactttcaggccccagctgttactacccttactccctgctacctctgacacgtacacagaaaacaggagagcatagaccaatggccttgtcctcatgacttagtttttttctaatttttaattttaaaatttttattattttttaacttgatttttttttttaaatagagatggtcttgctatattgcccaggatgatctctagcttctggcttcaagctgtcctcccaccttggtctcccaaagtgttgggatttacaggtgtgagctgctgtacccagcctaattttgatttttttaacctgacacatcataataaatgcatacataaattgtacatatttatggggtacatagcagtgttttgatatatacaatatatagtgatcagatcagagtaattagcatactcaccatctcaaacatttatcatttctttttgtgagacagggtctcactatgttgcccaggctggagtgcagtggcatgatcttggctcactgcaacctctgcctcccaggtttaagcgattctcctgcttcagcctcccgagtagctgggattacaggtgtgtgccaccatgcccagctaatttttgtatttttagtagagatggggttttgccatgttggccaagctggtcttgaactcctgacctcaggtgatccgcccacattggcctctcaaagtgcggggattacaggtgtgagccaccgtgcttggcggggtgtttaactttctgtgcctggcttatttcacttaacataatgtccttcaggctcatccatgttgctgcaaatgacaggatttttatttatttatttatttattttgagacggagtcttgctctgttgcccaggctggagtgcagtggcatgatcttggctcactgcaacctccgcctctcgggttcaagagattctcctgcctcagcctcctgagtagctgggattacaggcacacgccatcacacctggctaatttttgtagttttagtagagacggggttttgctgtgttggccaggctggtcttgaactcctgacttcaggtgatctgcccatctcagccacccaaagtgttgggattacaggcatgagccactgtgcctggccaggatttcattttttatggctgaataatattccattatgtatatatgccacattttccttatccattcatctggttttggacacttgggttgattccatatcttggctattgtgatgtagtgatgcagtaaacacgagggtgcagatatctcttggatatactgattttttttcctttggataaataaatggctagtagtgggattgctggatcatatggtagtcctatttttagttttctgagaaacctccatactgttgtccacagtggttgtactggtttacagtgctgctaacaggactcacatttgcttctgagttaagtggagacaggaatgggaattcttttgtgtttgtttttctttccaactttttaaaaacccaaaattatttatctccacattgaagttcaggaaacctcaggctgctatccctggggaagaagccatagtggaatggcagaaaccctgagtagagattcagaaaaaacaggttctggttgggtttcagctcacaccttctgattttagtagagcccttttaccagggtgatcctctacgagggaggaagcatggccaaccctagcctctctgacatgcttattcatcactcaggatgggcccttctttaccaattgatttatttaataaatatttgtttaacgaatatttgattacgtactttgggccagcactgggcttcacccttgatcagtgccctgaagacgctggattggcatgacctacaattgacatgatctgttcgagacactggcttgcttcctttgaaaattatttccaatattgtgaattaaagggaactcctaggctttaggatatgtccctggaatcccacccccccttagtttccttcctgggtgttttcttccaaaaagcctggttctgattgtgccccaccctgcccagaacctctagactggctggccactgccaacaggattaaggcccaaccttctagcatagccttcaatgccctccacttatcttcctagactctgccctctcttcactttgcaggcctcattcaccctggagtaggactgacttctaaagggaccatctgcatccttgcctccttctgggccatcatacatgttgttttctctacctgggacatttgagtgctcttgtgcctaccctcacagtctttcttttccacaatccagcttattctttggaaatcagtgcaaacactactttgaactgtggttcctaatttccacgaaaggttttctctgttcttctattatggcacttttcagggtctcccttgtacattttagtttttgtgtttttcagtaagtgccttgagatcagggaccggttctactggtctgttccaaccatagttccttaaacattgtgttccattaatattgggtgaattgaaatgaatttataggaagctccttaacctggggtcctcagacctctatggggtccatggacagaatttgaagtgggaaggatatatgaacttggatggaggaaaattacttatttgttttttaccaacctctcctttgtaatttagccatttgttcaattataatgtaggcaaataaaaataaaaataaaaataaaataaaggcagcaataatagcagtacccatgaccttgttaccaactcttaggctgtggagtgttttcctggattctaccctttttttaaggtttcttaataatagaagtttatacagaaactatctaatgtacttttttttttagatgaagtcttgctctgtcacccaggctggagtgcagtgacgtgatctcggctcactgcagcctctgcctcctgggttcaagcgattctcctgcctcagcctccagagtagctgggactacaggcgtgcaccaccatgcctggctaatttttgtattattattatttttttgagatggagttttgctctttttgcccaggctggagtgcagtgacgtgatcttggctcactgcagcctctgcctcctgggttcaagcgattctcctgcctcagcctccagagtagctgggactacaggcgtgcaccaccatgcccggctaatttttgtattattattatttttttgagatggagttttgctctttttgcccaggctggagtgcaatgacgcgatgtcaacttgctgcaacctccgcctcccaggttcaagggattctccgacctcagcctcccaagtagctgggattataggcatgctccaccacgcccagctaatttttttgtatttttagtagaggtggggtttcaccatgttggtcagctggtcttgaactccagacatcaggtgatccacctgcctcggcctcccaaagtgctgggattacaggcgtgagccaccgcgcctggcctaatttttgtatttttagtagagatggggtttcaccatgttggccaggctggtctcgaactcctgacctcaagtaattcgcccgccttggcctcccaaagtgctgggattacaggcgtgagacaccatacccggcccctaacatacatatttttatatcacaattagttattgtatatttctcaaaatattatttatgctcaatacacgtttgaaattacagtggcaataactaactaataagacctagtgctcggtaattacttaatatgataataagcacatattattaaattttgatttatatttcaaatatttcgatataattttgttatattgtatctactttatttcatgcatttacaaatattctaagaaggggtccataggcttcactagacaggcaagaatgattcgtggcacaaaaaagtcaagatgtcaaatttccccatctttgtatgtgtatattatgctgtatctatctccaatatcccttgtttggtacccattcatttagccaacatcttgcatgagtacccattgaatcttgagtactggaaaggtaattctaagtaagacgtaaactttgagttgagaatgaagtctattattctaaaaagcccactgccccctttctattctctcctgtcccttcagtcattggtgttttgaggtcacccttgacccagctcaagggtgatttgaggctggatatagtatggtgcccctcaaattccagtccaatggccccatcctactttatgacggcccattctgtaggggtcactgacttggcaggaagcctagggtaggaccaaatcaaagtggctaaccttgccttactcccactggggtacttgccttacttgttcctgccttcagggcctttcctgtcccattgtcaatcctaaaatagatttcctccttggctccctagcgagatttatttacaaagttgttttctgggcctgatcctcatcgtaattgtttatctggcaaaatagctgcctggccccctcttccctgctcctgacccgtgtgttcaggaaagtcctagaggttcaaagactgataaggtttaatgtcttactcactccatggaaatttgcatctttggcaatactatatctagtgctttccctcaatactataagcagtatgtgaccaacttagaaaatgtagattagattttttttttttttttttagtttaaagaaaggagaaagcacccataagatcaccaccccaaaaccaagcctgactaatacttggacaagattccaatcatccttctatgtatacattttacaaagttgagctcacggactctatgaaatactgtttacatttcctcaatattactaaagtgtcttccgtgagcatgaaatagtcttcataaagattttgtatgaccatataagaagccattttgtggctgtactatatacattatttaagcaaaatatctaacaactaaaaatcaatcttttttttcttttaatgggagacttttgtactctgtaagaggaatttagcatattggtttacattgtgaggtttggatttagacctggattcaaaccctgtctcccctgcttaatagcaatgtgactttagacaaatacctatttctttatctccaatgtggagataatactctacttcacagggtgattattgatattaaatgaggtagtacatatgaagtgcctggtgagtagcaagtcttgatacaggaaagctgctgcctgttactattactactgctaccattactactgagttttcagccaaaggactaaatctctaattatgaaatttcagctatcattgacctagcttcgaggatctatttgtaaaggtggtattttttctagtgcccgtgaaatcatgtgtgtggctgtctcttattttggtctgggcctgtttctgcacctttgtcctcccactgagttggctttggtagcccctctatgccacccatacccacctctactgaggcccccttcccctcttgagcctaaggaagccaatgagacataaatataggaagcattagcaatgcaaggcagtatatagaaccaccgacatcagcactgaaatggtctttggaccatttatctagtttaattggctgccctccatcccattcctgcctttgcacaggtaagggaaactaaggcccaggaaaaggacaggagttatccaaggttgtagatttgaccagctacatgctaggcttggaatccagtgttcttctttgtttttaatttttattttaagttcaggggtacatgtgcaggtttgtcataaggtaaactcatgtcatgggggttcattgtacagatcattttatcacccaggtattaagcctagtacccattagttattaaaatattttttcctgatcatctccctcctcccaccctccaccttctatgtgtctgtgtgttctcatcatttaattcccacttataagtgagaacatgtggtattctacaacctctgcctcccgggttaaagcgattctcgtgcctcagccaccaaagtagctgggattacaggtgtgcaccaccttgcctggctaatttttgtgtttttagtagagatggggtttcgctatattgtccaggctggtcttgaactcctggcctcaagggatgcgtccatcttggcctcccaaagtgctgggattacaggtgtgagctaccatgcccagtctggcatttgattttctgttcctgcattagtttgctaaggataatgacctccactccattcatgttcctgcaaaggacatgatcttgttgttttttatggctgcatactaacatacattttctttatccagtctaccattgactggcatttaggttgattccatgtcattgctattgtgaatagtgcttcaatgcacatgcgcgtttatgtatttttatgatagaatgatttatattcctttggatatataccccataatgatattgctgggttgaatggtagttttgttttcaggtctttgagaaattgccacactgttttctaccatggttgaactaatttacactcccaccaacagtgtataaaggttcccttttctttgcaatctcactagcatctgttattatttttttttgattttttaataatagctattctgacttgtgtgagatggtatctcattgtggttttgatttgcatttctctaatgatgtaaattttttatatatgcttcttggccacatgtatgtcttcttttgaaaagtgtctcttcatatcctttgctcacattttaatggggttgttttttttcttgtaaatttgttaaagttccttatagatgctggatattagacctttgtaagttgcatagtttgcaaatattttctctggttccgtaggttgcctgttaactcgatagtttcttttgctgtgcagaagctctttagtttagttagatctcatttgtcaatttttgcttttgttgcaattgcttttggcgtctttgttatgaaatctttgtccattcctatgttcagaatggtattacgtaggttttctttgagggtttttataattttgagttttacattacttttacatttaagtctttaatacatatagagttgatttttatatgtgagataaggatggggtccagtttcaatcttctacatatggctaaccagttatcccagcactgtttattgaattgggagtcctttttccattgcttgtttttgtcgactttgtcaaagatcagatggttgtaggtgtgtggccttatttctgggctctctattctgctccattggtctctgtgtctgtttttgtaccagtacaatgctgttttggttactggagccctctagtatcatttgaagttgggtagcatgatgcctccagctttgttctttttgcttaggattgccatggttattcaggctgtttttttgtttccatatgaattttaaaatagtttttcctagttctgtgaagaatgtcattggtagtttgataggaatagcattgagtctattctatgaattgctttgggcagtatcaccattttaacaatattgattcttcctattcatgagcatggactgtttctccatttgtttgtgtcatatctgatttctttgagcagtgatttgtagttcttcttgtagagatctttcgcttccctagttaacagtattcctagatatttattcttttgtggcagttctgaatgggattgccttcctgatttggctcttggcttgactgttgttggtgtatacgaatgctagtgacttttgtatgttgatttttgtacactgagactttgctgaagttatttatcagattaaggagcttttgggccgagactattggattttctagatataggatcatgtcatctgcaaacaaggatagtttgacttcctctcctcttgcttggttgccctctatttctttctctggtctgattgctctggccaggacttctaatactatgttgaatatgagtggtgagagagggcattcttgtcttgtgtcggttttaaaagggaatgcttccagctttggcgcattcagtatgatgttggttgtggctttatcagatggctcttattattttgaggtatgctccttcaatacctagtttattgagaacttttaacatgaaggggtgttagattttattgaaagctttttctgccctttagattatcatgtggaacccagtgctctttgtcctgatattaatttgcctctgcaattgtttaccagtgctatagataatccaggtagatcagaggtgagaagagaaccctgtgagatgaagctgtctagtatagatggaaaggccttcctggaagaagtacagttatcatttgcctgctcttagttgtaggctgatctgcattcttttttaaaaatttttttgagacaaagtctcgctctgttgcccaggttggagtgcagtggtgtgatctcggctcactgcaacctctaccttctgggttccagtgattctcataccccagcctcccaagtagcttgaactacaggtgtgcaccaccatgcccggataatttttgtatttttagtagagatggggttttgccatgttacccaggctggtctcgaactcctggcctcaagcaatccacccacctcggcctcccaaagtgctgggattacaggcatgaggcattgcacccggccttcatgcttgtctgttctttggtaagtattgctctgtggctgtgttgtttgtcttcaataagctgcttgggagcaggggttgtgtttgggtcaatattctcccttcatccccatcagtatctaagttgcccaggctcttagcatcctaactccttcctctgtggttgagcagagacacttgtctcaggctctgttgaacacagagccagatgactaacctgcttcctttgatctcatcctagatcagtgtgcgtgtgaccaccatggatgcagagctggagtttgccatccagcccaacaccaccgggaagcagctatttgaccaggtaaggcggagactccttagcctcctctccttctctgaatagcttccaccacaatgccaacaatccatgacttttgcctcttgtcaaagaatctctcttcctgttcactccaagatagatcaaaatgaaggctgattccagacttaatatgaaaggaggcaaagttaaactttggcagcctgcaccctatggtcctgattaattttatctttggtcctgaataagggagaaaagaaaatggtgtatattctatgctagatgctttaaaaatcttagcatatggagccttccttttaactctgaaacatgtaagtgatgtcttctccattttaatgatgaggctcagaagttaaataacttaattgcacccaaatgatatttggctgggatttgcactccacattgttgccactgcaccacactgcctctgtcccatgtttttgcttcctagtagaaggaaactaacttactctccctgaggtagtaagctctatgcacatttctctcaaaagaatgttgggacttaggacaacatgggagttgatggatgcagtaggaggctgcttcatctcctacaggcatgccatgaagataattgcttactcgccatagtgaagaggtcattcccatctccaacccaaggggtgtcccttcattgtgaatcattattgtcagaaaggatgtactgtatactataataaacagatggcagctacagacatttttagcattcaagggaatgtgccgtctgtggccagacttctaggagcaaaaatgaggctcccatttccagaggctgggacctcaccagacaggccattatcctatttctccaccagactccgatgaagtggaggtctgagttattgtccaggatgttaggctgcatatcaccctgatggattctccaggccctcttgcttccctttcttccttgctctctgtgtccttctaccatatgagaacttccccagggttggagagaggaagaaaaaaagaaggaggtagtgttcaaataagctaattctattcctgtgaatacttctgactggtgagagaaaagacaagagtagaatggagacaggggtaggagagggctagaaatttgaggacagcttgggtacaccttctgagttcttattacatagagtgggaaaattattgtctgtggctaatacagatgagagttaacatttatccaggactcagtgtatgctaagtattatgataagcatttgactatcacaaagctctgtgagtgcatgaattagtatgggcatgttttacagatgaggacacaaaatcctcattttcctagttagaccctgggaaaattattgaactctctgggttggtatcttcatcccctccccccgagaaatatctaatacttacctcacaggatttttgtgagtgtgttatgttttgtatcttacctgttactcaaaaatctgattatagtggcatataaggatgtccaatccaaaaagataaattcgaaataggtgagaaagataagaaaacacaaataggaaagaaagtgttagctggaagaaagcatccagcatatggtagagaagtaataaatgatagctccctttccaataccattgtgcttcttgtattattaattgagctggagttgacgtgatgtggtggctcatgtctgtaatcctaacactgagatgggaggattgcttgagcccaggggctcgagaccagcctgggtaacacagcgagaccctgtctctacaaaaaatttaaaaattagcatggcatggtggtgcacacctatagtcccagctactcaggagattgtgccaggagggttgctcaagcccaggagttcaaggttacagtgagctatgatcacgccactgtactccagcctaggtgacagagcaagactctgtctctaaaaaaaaaaaaaaaaagtaaagaaaaataatctagaattgggagaattgggagatgggcttaatgatcctcagaatatctaacttcagatttaggtggaacttacttctctggagtttgttttgtgtttgttttactttgaatggcaaagtgtaatcattgatacttaattggtgaaaatacaaattagtctgaggaatatttaaatacaagtttactacaattaaagtgatgtgcttacattcacatagctcacaagtgattatggtgctagtctggaatgactaaatgcattctaattataattgtgctttgcattctctcttcacatggaggttatattggagaacttttaaagggacagcctagtgaagtcaaaagggcctggatagaaagtcatgaatcttgggctgtagggttggctctatcactaattcgctgtgatacaaacgtttcccttatttgggcctcagtttctcatctgtacaatgcctaacttgtttctcaaatctggttatctctcagaaaatttatctctggcatttatttgtgcattccatctctctttctctcccatttctgttcctagtattgggatttcagacaatccttttctgtaaaaaggagagaaatgcctcacctgagtatgatcagctgctggcatatgtgaggaggtagggctagctggcagggggatcatctcttccttgacaggctttttactgtctctaagacaaaagggaggaagtgtccatagaacacataggcttttgggccctttgctttagacagcagtatcattctgggtagcagctattagagagggaagcggttagtcagtgcagattttacagaccagctgggagccagaggctcctttgacatttacctatactccttccaagagccctgattctactaattccccatcccaaaccagatgacgccatcctctaccctcaacactgggggctttgtatatgtgcattgcagggggatggctgtggaggatgaggaaggcatgatttggagcctagtgggggcagaaaaattcttgaacaaagaggtttattaacttcaaaaaacctcaatgcctggtagttttttgttagtgttggtttggtttgtgtgctgtgggtgtggatttgagggaagtccagatagtagggaaccccagatagtagggaaccctgggcagattggtatgctagttctgaatgctactgcttccaaaacaaagcctttgggagacttggaaaccaagaagtccatgacttctcatcattgttatcttgagaagtatcatttattgagcacatactatggcctattcctggctaggcgctttaatcctcacaatgctcctgcctctgtgaggtgaaagaacatactctaggtcatgtagttagtaagttgtgatatggaattttgaatacaactctgatcacaaaactatacttttcctgcactgcactactctgtttggggtgattgggagtattcaacttagagaagactcaaggaagatatgctttctgtcttcagacctctgaaggactatcataagaaggaggggggcagtcacattctgtgagtcagagggacagaggtggaccccacaggtgagaaaatacagggaaaaagatttgaactcaaggaattgagcatttggccctcttgaggccaaggcaggtcaggtcaggaatcagtagagttatgtgttcataggcatttgggggatgtgagctcttctctctctaacttgatgaggcataagggaggaagtccgttctgtctggctcttgggacccatcattcaaggaggccctcctggtagagcctgggcctgggaggaaggagctagactccttggcaggaattggcaaaagctttatggccatcctggaacgcagcagtcatctggccaatgaccagagaggaagccaaccagagaggaagtactccttggcaccagcaataaataataggcaacaatgggatgccatagcttgaggaagtctagggcctggtgggaaagggaagtaggactcatagtttgtctcatttacctctcttcttgtgagtgtgctacagctagaggggagagagaacatgttttgctatagtgattttgtcacttgcttcaacttctaaagcttttgatcttggattacctaggtgccactaaagggctgtgctcaaggacagaggtgaaatctcaaagcatcgattcattcatctatttactgattcatttaatattgactgaaggtctacactgtcgaacaccatctctgttcttcaggaacttggagttccttacctataaaagcatagaaaggcacatgcaactctctacccacaaagaaagaaataaacgcccttgaggtcaggttccatggggtgatatataaagcataggatttagaaccagccctgagttcaaattctgtcctgttacttcgctgtgtgaccttggatggctcatttagcctctcagtactttcctttcctttgtaaaatgataatcatgctaatctcagattttgtgatttaatcctcaaataagtaaaatgcctggtgcataccaagcattctaatattggtggttcttattaaggactaaagtaggtggcattgccctgagagttcagatgagggagctatgaaatcaggaagttcttctggctcagtaaagtacttaggacttgaatactctgcaataaggacagtaaacctttttttttttcattttataaaataactaacatatattatagtaggaggatctccatcttacagatgaggaactgaggcttacagaggtgaaattatctgtttaaggtcatatagctaggaagtggtatagctggggcttaaaccagggcacatagcatttccagtttttctaatgcttttgatcaactgtcctctggaaccttcttccactttacctgcttccaaaacttagaaccctagctaggttgggcatggtggctcatgcctgtaatcctagtgctttgggagtccaaggtgagaggatcacttgaggctaggagcttcagaccagcctgggcaacatagcgagaccccatctctacaaaaacttaaaaattagctgggcatggtggtgcatgcctgtagtcctagctacttgggtggctggggctggagaatcacttgagtccaggagttcaaggttacagtgagctatgattgcaccactgcactccagcttggttaacagcaagaccctatctctaaacaaacaaacaaaaaacgataaaagaaagaaacttagaacctcagctgagtatgttctctgttatagagcaggtgaccacttgaccacaggcaatgtgtaataacagaaacagcaatagtggtagcccatcttggtgctttccagtggtgcaataatttgctttcaggtgggtggctgatgcagatgctgccaaatctgtaatggtatcttgggggtctcaggtgtttgggcattgatgcagttttgcacattgtttctcacacagttcttctcttgtggctccagcattactccctcattctcctctaggcgtgcacgctcgtgtgtgtgtgtgtgtgtgtgtgtgtgtgtgtgtgtgtttggagacaaggtctcgctccgtcacccaggctggagtgcagtggtgtgatctcactgcaaccttcgcaccccacagtctcaagtgatcctcccacttcagccttccaagtagctgggaccacaggtgcccacaccagctatctttttgtatttttagtagagatggggtctcaccatgttgcctgggctggtctcgaactcctgagctcaaaagatctgccccgccccagcctcccaaaatgctgggattacaggatgagccactgcgcccggccatgctctgggcttttgaagtggctgatgacatcactagtttgtttactcagataaatgcatgggggattcaagaagagaatttctgggcttttgaagtggctgatgacatcactagtttgtttactcagataaatgcatgggggattcaagaagagaatctctgggctcctaagctgacctgatctccgctcccctctacagacctcagatgtaggttgcctccacatgtcaaaaggaggtaaagggtttttttttcttgcttccagaagctcctgataattaacgaggatgtactccaaggcagatcttttcttttcactgcacctcagttttccattttatgttgcttgaaccctgtaactctccacagtcatggagctgagtagaatacacaacctccagtttcttaagctagtgtcttaaaaactgaagtcctactttctttaggtgtatggggcaggttccaggagggatacaaagctgtgagatgaatgtggtttagtattctagagcattaattttacttgcaataattttaaaaattcattatttatggagtagaatataaaatttgcacaaataattaaacctgaggcttcaaagaaattatagctgggttacagccatctacctattatctccccctaccccatcctaccacaccccctatgtcccttgggtatatgcattcattattttctgctgcttaaggattttttccatgggagctttgagaaatactggctcagatccgataagctggctgtcgggtcaaagggagccaataaagaattttctttttcctcagggataggaccatttctcagagtggaatgataaggaccctagtcactggagccacagaggttattcctggaactggaagctagatgctaagctctcacttgaaaataaggtttctctttcctctggaatggaggtctcaactggaagcaaagctggaagcaagaaaaacttggcttggaaaaggggtttagagttgcctgataaaatggttcacagcacccccatgggccttagagatttccttgtagcctggggtcaggagtcatccatttttgttctttgttctttttcagtttcaattctgatttcagaccatatttccttcccgccacgtcctcaatttctcactttgagacttcagtgcaggctgagagatattactcatctctttaagccctagagcctaaggaagtggaacatttatgtttctgatttctttatgttcacaaaggaagagacagtgctcagagagatcaccctccctccccccagcactgagcctgaattctctctttttttttttttgacatcactttaggtattactttgcccaacttctcctgagttactctggatctcagaactactttagtcaccatgatccttctctctctctctctcttttttttttttttgagacagagtttcactcttgttgcccaggctggagtgcaatggcgcgatctcggctcactgcaacctctgcttcctgggttcaagcgattctcctgcctcagtctcccaagtagctgggattacaggcatgtgccaccacacccagctaattttctatttttagtagagacggggtttcaccatgttggtcaggctggtcttgaactcctgacctcaggtgatccacctgtcttggcctcccaaagtgctggcattataggcatgagccaccacacctggctaatcctccttctcttatcacacccctactcccacccaatagtgaaacagacaacgtggtgcaaaaagaggctaacggtctcactcctgggatttctgggactggctgcatagtctgtgcctacctcacttcctttcagtcttggagtctcttagcctctacaattagtctgttagtacaggcaaagaccagttgctgcttgtctgagtccattttatgtttgttttgttttgtttttgtttgtttgtttgtttgtttgtttttgacagtgtcttgttctgtcacccatactggagtgcagtggtgcaatctcagctcactgcatcctccacctcccaggttcaagctattcttctgcctcagcctcccgagtagctgggactataggcacgcaccaccatgcccggctaatttttttgtatttttagtagagaccaggtttcaccatgttagtcaggatggtctcgatctcctgacctcatgatctgcccatctcagcctcccaaagtgctgggattataagcgtgagccaacacgcccagcccattttatgttcttataataaaatacctggagctagttactttatacagaaaagaggcttatttgtctcctaattgtagtggctgtaaagtccaagagcatggcaccagcacctgctcagcctctggtgagggcctttgtgctgtttcataatgtgacaaaaggtcaagtaattcacagggacaggggtccccatgactgaaacacctctcattacatactacctcttaatgattctacctcccagcactgccacaccggcaatgaagcatcaacatgagttttggtggggacaaaccacatccaaaccatagcactgctctactacttctgttccaagtctgttctccccccatgacctaatatcctggccctcatggtccatcttcttctcttcagcatcttcagtgggtcttctctctctctctctttttttttctctctctctcagctggattgtttcttggatcttgccttttcccaccaattgcatctggacacactattcttctgcaaccctgtggaaaatgattagaactgttaattgggccttgggccctgtttagatctaggatgatatacaaggtgctttaaaaaaatcttttctgttcacgcccacccactaccttcatcctctgcaaaaagccaatattacatttcaacataagcattcacatttctccatctgaaactttctggcagttccagctgcctattgacttagagtcagggaatcaactggccattgaattctggaagccttttgaactttcctcattacctcccacccccactgatcttttctaaacatgtttctaattatccacatcagcaagaggtagctgggaaatgggattgtttttattaaccatttgcaaaataaccttgtaatgtaattagtacaatgatagaacttaagagaaaaaagagatcattgaagccatactccccaatttggatagataaggaaggcgaggcccagagaggaaatatgctaccttgatatcatacagctagttggagacagacatgaacattttgctcaggtttcctgatacttgatccaagctatgaaggggaagggtgacctggtgagcaatgaaggtcgatgacttgggggacatggcttctccccaaagtggttgtcgcttgggtctagtgggaatgccaggaagcatatctcgatgcagaagtgatcaaagtttattacctggatgggaaatttgggccaaaggagagacaaggcaattaatcacttgagaagctcaggagtcgtaagctcatatgagtacttggcattaggacatagcatgctagagaagaaaaggtacaagctctatagtcagacacatcatggttctatatggctctgtaattttagatgcattacctctctaagccttagttcctcatctataatatgggtataattgctatctcacagggttgtttactgttcagcgcctgacacatgattggtgcttaataaatatgagctacttttttctttggggtctctgaagctctagattgtaaactctgggtgtgactgtggggcctgactttggatgcataatagaaactttgtggatacagtgttagtgtgtgtatgtgtgtctttgtgagtgagtgtgtgtgtgcatgtgtgtgtgtgtattttgaagggagatattaatttgttcataagggaaggacatcagcaaaactgggtccttgttccctgcttccatctccaggtatatttctatgattctttctcaccttacccttaccctccacttgcatccttctcccaaaaaacaaaataaaaaagactgcctaaggccagcctgacctcattaggatgtggctcagcttcactgctgccatcgacagtggtgggtatgctggggttgagctgagggccagactattaacatgctaatgtcagggactagagaacagagctcatctgtgttctcttggcaagcctccttttcctgcccactgttcagccaggaggctcaggacaacagggggcacctcagctgctacactgaggtacttaccctatttctaccctcatttccaccctaaacctgtgtaagaggaatcatgacttggctctgatcagggttggaaaaaatcctctcagaacccaggcacagcatggcttcagagtccttcacaatccccgttttatcttctcaaacattctttatttggggtattgtaaatggaactcagtcttaagggtgtgggtattacccccagttgctaaggatgaaggacaatatatgggagtggcccaagagaacaagatacaggagttaatccaacaatctccaccttcagcctttaatccatcatggaagtgggaagtggtgtgacattgtagagggaaggaggaggtggcagaaatcactggatatgcatggatttggagtcaaacagacctggtttgaaccctaattctgtcactcacaacctgaaacttgggcaagttatttcatttatttgaacctcatttttgatatctataaaatgggcctaattgtaagtctagcataggggtattatgaaaattaaaggagatgatggatgtaaggttcttggtatgtgtcagtgctcataagtaatagatccctttcctgcctcagcagtactttgtgcagagagatgccgacatcagttcttgattgctgctcaagtatattttcttgccagatgctgagcaccttaaaccctttaagggcagatataatattgacttcaaactttgtgtcctctgtgcctcacacagaggaagtattcaatcaatggttggttgttttggttttctcttctaggtggtgaaaactattggcttgagggaagtttggttctttggtctgcagtaccaggacactaaaggtttctccacctggctgaaactcaataagaaggtaactgcttattcctctgttggatttagaattcttttcttttccagaacattcctgggagggtaccatgtgctagttggcaaatcctggatacctagggctgtgtttgtgactgggtggtctgttgaccacttggatcagaataaggaccgaggacacaagcaaggcaaagctcttgctctgtctctactttgacttctaacagcgacaatggccagcattcaaagaagaagagactcttttctttctaatgggaacactagcttgaactttgacttgttttggatcaaatccattagtggcttttcaagagaggattggtatccccttcatctctccaaactcaatggctttaggggatttgtgttttttttgtttgtttgtttttgttttgttttgtttttgacggagtctcgcactctcgcccaggctggagtgcagtggtgccatctcggctcactgcaagctccgcctcctgggttcacgccattctcctgcttcagcctctcgagtagctgggattacaggtgcctgccaccacgcccggctaattttttgtatttttagtagagacggggtttcaccgttttagccaggatggtctcgatctcctgaccttgtgatccgcccgcctcggcctcccaaagtgctgggattacaggcatgagctactgagcttggctggggatttgttaaaaagagccacagattcttgaactagaaaaaaaaaaatctgaaagatcttacagtcttatgctgcaccttctccagcagtcaactaatgtctgaaccccatatagatgtttccctctttcttgatcttttacctcagttggaccccaaatgggatggtttgagtccatgcaagctctccaccccaagcagcatcttcacgggaacctggcagccttccatcttcgtatcctcaaactggctggccttgtccttagaagtctccatactgtcctgcagtttgcttctctgattgtgtctagggagtaggtaccccaccttctgctggtagagtcttgttttcctaaagagttgagtcttttgctggacaagtgtggagccactagtattccatttcaggctttaaaaaatggtctaatttgtgctcttgtttagccagttctcagtcctcagacatatatcctagtccttactttgctaatttatgaagttggaggagacttataagacgagcttaaaagaagagcttatgcctactatcagaatttggggatagttggatatagtcagataaaagtggtttgaagatttctgatcatcagtcggtattaaggtaatttcaggaagaaattcccaacagaaagtgattacagacatgggattcagtccccagtgaaagtaatgtattatttttcttaattaccaggggagttgccacccagctgtctaagattatgcaaattgatgatctttcagtgttttctccccaccctacagccactccattacccttaaaacctattttttgagagtccataacccttactcttcccaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagaggtgaggtggttccctgccctcctttgccttggccataaggggctgcagcccacagctgaccaatccctgcctcacagggatgccagatctgttcttctccattggggtctgtctgaagactgtgttatgctgctcaagagacatttgcatatagtgtcagactctgttgttgtttttctggctttccaaataaaaagcctttttgttttccctctgtctacctggttacagaactttattaccctggaggcaggtgcttatatagaaccagagattgagtaatttctttcacccatccctggttccattttctcagttctttttactgatttagatctcttatatcagaagttcacaggggagagagagaaataagcaaaccgaggacatggggagctcaaatagtcttttaatattgacagctagtgtacagagctttccccttttgtaaacttcaaagtcaaaagctctaaaacactcattatttttgtttttgtatcacaataacacacaaaatgaacaaagcaggcaatatccttatttcctggcgaaggaaatagaggtgcagaggtactcacactgactttccccatctggtgcagctcatctgaggcagagccagagccagacctggaagcttagcaccttaatattttaacactaagttttttcctactatacccaatggccatttccatagtcttttggattagaaggaaaagctttgcttcattctgggagcctcagtcccattggagttatggcatatatgtacaacacacccataagatattagggatagtgcttgtaccctggggactctacctgagtcattgccatgatatctgagatggcatgtttaaagcaaaccttgtttataatctagtaggtcttggaggttgggcctgttggtttttctgaaagccattaggactcagttcattgctctgtagccaaaggccatcctttcatttctgagcagtattcttataaacatagagtgttggtcctaagaggatctaggagagagtgtacctgactccatgaggtccatccctactgttagcccctaaagtcagcacaaactcctgacacattactgctatgcttagggaccacagcacatcatttgatttgtggatgaaggtacaaaggaaggtgttccccttgttgtttttgatcatccattcttgtagctctcttacctttcaggcaattccttgtgtctagtttaacaccttcttgctataatttcggtctgcttccagtgtgacctcaattggctgactctacatcctctttgcatcagccccttagaaagctaaatgggcttcccttctctcctgcacagggactttgtgctttaaactactcatcacccattgtctttccagagtcctggaacagcacaaactcaacaaggaccagtgggaggagcggatccaggtgtggcatgaggaacaccgtggcatgctcaggtaagcttgcccaagcagtggtgggccccacttcccttacagggtgaatgagaatgcgttctagggagaagagactgatgacaagggacattggtggatgttggagaaagagggaacagggacgatagaaggcaaactaggaccattataaggctgttttttgtttgcttgtttgtttgttttgctgaatgctggtaactggtagcccaaacagttttgactatcaagaaatggagggagctcttacacatggcaaagcatttttgagggttgtgtagttgaaggacaaatatcatcattttgccatcaccacattctgagccctgctaagaatgtgcctttataagaggctgtcacaatgaatgagagaaagaaaattgcttctatggcagccaacatgccagaggccagcaagggtcagcccatctttattccccttgggagcttagaccctaggtttttgttaggagattttgctttgcaaaagtcatgctgtgctctgttctccatcatctgcttgccttttgtcccctttcccactcctgatagcaagatccttgtcagaagtacagagtaagcaggctttctatctccttgggtctgactcacaagccccactttgtgacccccaactctgtgtcatttagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacaggtatatctcagatctcttttagtttatttaggtcacgttaacatctagggctcacttttcaccaaggagcagggccatatctcttgggtcccatctcagttctttttctacctaatttagtccagcccagatgatttcacaacttcccttagtcaatactaaatcctgtattgactagactcacactgtcaactatggtagccaccagccacatggggctattgaacacttgaaatgtggctactttgaattgagatgtgctgctgtaagtgtaaactacacactggactttgaagacttagtgtgaaaaacagaacgtaaaatgtcttaatattttaaaaaatatttatttacatgtttaaatgataatattttagatatattgggttaactaaacttactataattttattacatccatttctttttacttattttcatgtggctactagaaaacttaaaattatatatgtgacagtcattatgtttttattggatcgtgcaggcctagactatcttatcagcatttgtaattagtctcctgtgatggttaagtggcttttggcctataatcctctcactgtagccttatcccacttgcttatatttttcacttggtgtgctcttggtgaggatggagagcaataaattattgttccatataactcctgaatcttggagttcattatttactttctctcaaacttttgtaagcttggatagaagagactcagttaaatagggctggggattcccttgaggaactgttacaagttccatgcctcaaacaaatacataacaaaacaaacttgagacaaggaatcatatgttagttgtactatcaggagatctttagtgaactctcaatgctggcagctgacctggtggcgtgtgatgacactggctgagctgtcactgagtctacctcctccagagagaagtgtttgtttggccaggctcagtggctcacgcctgtaatcccagcactttgggaggctgaggagggaagattgctcaagcccaagagttcaagaccaacctgggtaacatagtgagacctcgtctctatttattttaaaaaaaaaaaaagagagagagagacatagaagcttggaggtgacagtgagggcaagcccccagttctctacacccttcttgtcttgcccttgtcctgatgttattggtttctatttctacagactaactcccaagataggcttcccctggagtgaaatcaggaacatctctttcaatgataagaaatttgtcatcaagcccattgacaaaaaagccccggtgagtgattcctccctctgaccaagacaggtacttgccaaggcctgcataatgagcaatcatgctattctatttttctcttccttttctgatgtgtttgtgtgtacgtgtgtgcgcgcatgtgcacgaacaggaagcacaaatagagattgggaatggagggggatgttgatgccaagaaatggccagcagacatcctgtacctggttctactctgctacctgtctctctcactgtggatgtgggagagccacaggcagtgttaagaactgcttcttagccattgcctctgctgccctgaggttctggggtggaaaccgaatgcatctcatatttccaagcccctgggtcccagaaagtggacactgttcacatatttgattccttccttccttcctctctctctctctctctttcttttttttgatggagtctcgctctgttgcccaggctggagtgcagtggtgcaatcttggctcactacaacctcagcctcccgagtagctgggattacaggcgcatgccaccatgcctggctaatttttgtagttttagtagagacagggcttcaacatgttggccgggctggtcttgaactcctgacctcaggtgatttgcctgccttggcctcccaaagtgctgggattataggcgtgagccaccatgcccagcccttgacttcttttttttttattgtggagaaagggctgtggccaaagtccaaatctgaagatgatcctacagacttcttggtagaactttactgctgccctctcagacttttctccagagcaatccaagaccaaaaaagtgctttaagttcattcatttctctaacacactcgccatgcttcttacccactcagtagcctgcagctgacaagaccagacagctggtgattgtgggtaggttaggaaactgagctgagtgtccccttttctgggatactgcatgtccaacaaggcccagtgacaatgctgagcctgacccttttcatgaaggctcagtgattcttctccagccatgaggtgcctgaacttcccctgctagggactttacacatgttgtctccttaaaccctcagcaacatggtcaggtaggtactaagtagcatactaattttatggctgacaaaactgaggttagagagatggagtgatttgcccaagatcacacagctaaaaatggtagagctgggatttatacctgcaccccaagctatatgagacagtagcagtgtgtggtcagtggcagaggagatggtggtgcccatcagctggtgacttcggtccagtggtatttgtagtaacaaactcaaactcactggattttcttgtgtgttttcttttattgctgctgtgctcaactattatcagaaaaagttaagtaacaaagccagctgagatcaagggctcattttaaaaacaacaaccaggacaagcagtgatcaggagatttatgtattcatgtatgtatttacagcctgccttgttccaaaaaggatttaaggggctgggtctaggatttgcttttaggagattgtagaaacagtccagccacccatactgcacccaccagggtattattcaggggtcatttggcttccaaaagaggtcacctgagacctagcatgttccctaattagcagagaaagtttgaatccttcaacttgattaagagtaatttaggatgctttcacaagcaaagattgaaagaaattgtggtttcataagcaaagattgaaagaaattatgggaagaacatgggtttcagagtcaagaaacctgggtttctagtcttgggtctgtctactgtctaaccctgggcaagtcactttaccactctgataattagtcttcccatctgtagtgcaggaggtcagattaaatattctttccagtgcttttggatttagcttttcagaaggcagaagatcaccttcacctgtccctccaaattctttctgattgctgatttcccaccaggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcggtaggtgctgcacactgatgtggggggccagggctggggcaaggaagcttctcaaaggtgccctgcatgctaagtcaggacatgaggccaacctaggacttcatagatgagaggttagacaccaatattcacatttattcagaaaaaatctaccaagtttgaggggcagtttttacagagctggatctagcaggaaactgccctgtaggacctcacagtctactcagtctagtagcagagagagggaaaacaatatatacataactcaaggtacaaaggccatgtcattcattcacttaataaatatttattgagcaatgaataagaaaagaccaaaaatctctgcttttgtgaagctagcattctagtggggaggagacgaacataataaataagcaaattatgtggtacataagatggttaagaagtgctatggagacaaaaacatagaagagggatggggagaagggtaagccaagtattctgagggcccagatggagaatacctagccaagggagataagaaggttcctggaagaggtgctagggcaagaaaaagcaaaagcaaatacttattccagatttgtaacagactctgggaaaaagaagcctagagctgggctttagggcaggcagtgttagacctgaggactgatgcactagccgtagagattactagacttgaagcacttcatcccagcacagagccaaaacttgtctccctaacaaggtggatagggcaggtcttattggaccattttcaagataggggaacaagagcaaagcagtgacatagctaaggtcacccagtgggttggtgggagagctaggattcctgactcaggggtacattgacagggccccgtgtacactggcctatgtggggctatgatatgaggacaagggtatagaggtaagggagggtggcccaaactcacaatccctaagtgtgttgggaaggttgggttgagagacccagaggcagcaagccttggaattccccaggcttttttttttttttttagatggagtcttgctcttttgcccacgctggagtgcagtggcgcaatctcagctcactgcaacctccgcctcctgtcttcaagcaattctcctgcctcagcctcctgagtagctaggactacaggcgcatgccactatgcccagccaattttttttgtatttttagtagagacggggtttcactgtgttagccaggatggtctcgatctcctgacctcgtgatctgcccacctcggcctcccaaagtgctgggattacaggtgtgagccaccgcgcctggcctccccaggcttttgtggagcgttgttatcctgttctatccattttatctccttccctagtgctatgctggaaaatgagaagaagaagcgtgaaatggcagagaaggagaaagagaagattgaacgggagaaggaggagctgatggagaggctgaagcagatcgaggaacagactaagaaggctcagcaaggtgaggcttggagtcaccttggagattggatttttccaggcctaactctgagctggagaaccttctgcctgagctgtagactcagacaatgtagttcaggtgtggctacagactagaagaagaatgggcaagaagagagctcagaactttctgccagctttgtcttggggtggatcatttccaggaacgaagctattgtgtcgtctttatctctgtgctcttcactgccttctcccctccttttctgctcagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggtaaagctgtagggtgggctgggattatgggaactgaactttcttccttgtctgcctacttacttatagctacttttgcttacatgctggctttttagagcaggctaccactccatgggcctccagcaaataactagttcagaagcaagctgagaagtcactagtgtggcccagaaatttttgcagtcttccctaacccttagtttctgttcactttcttaactcttgggtatctgagctgattgacctggcaaaggaaagggaaggagaaaagaacaaaagggactcatatttgagctcctgctgtatgttgctgtgttgggaatatttcccttttccttacttatttcttcttcccagtaaccctatgggattaacctcatatgagataatatcccagataaggaaattagagctcagggaagagattcaccaaagatcacacaattgtagctaaataaggattagaacccacccatttctgcctctgtttgaaagctttgctccctgaaatcacatgcaaaactatgtgtctatgcatttttggggcatttggcatccatactttcatcacagtttccaagggttctgtgactcagaagttaagaacctgtggtccaaactccttgacatatactcttcctttgtactgttggaggtgggaatagagggaaccaagacctgtctctcatgaggaagctgtcatgggagatttacccaaggtgtgcataagcttttttccttgttcagatagctttgtgacacttgagtgtctttcctgtacttgtcctgggaagactcttagtcgaatcctgagcattctaggatatcaggaaaggatctgccacttcaggaagtgacccaatgatggccaaagctttactgaggcccccagctgcatacttgccaagaggggcagggggagagataatgaggaagggacagagatggcatattgtttgtcttcaagaggcctacagtctaggtgggggagctctgacttaaaaggaagtggtggtcagggaagatgggactggaatgaagtagtctggtaaaagagtctctgaggcagcaagcaagtggagcagtaggtcccttactagtcccccaggggacttgggttgaagacacctgggtcctgaggaccagaaggcccagctctcacaggcttccaatttatccgtaggccttggaaatggcagagctgacagctcgaatctcccagctggagatggcccgacagaagaaggagagtgaggctgtggagtggcagcagaaggtaagacacagggcctaaagcaaagcattgaaggaatgggtgccatatgcataggtaacagctccttagattccttatgttttggctccctccctctttcatacttcccacagcaggcagcatgggagaaggcactcatggtttcgtcaaatacttactggagttctctaatacctctaggaagttggtacaattgctcttgttttatggatgaagaaactaaggatcaggcagatgaagtgccttgtcctacctggtgcctgcctcttgccagaccgttctaggcatatacaggatgccacagtttaactggtctcactgacagtctttctctccttctgtcactggacaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggtatacaagtagggccaaggggcaaggaaactatatgcattgatttagtagcccatggcattccctagaccatcatgggggataggtataagatcctgtcccagtgttgtatgggagcccaagccgttcttaagtgacagctttaaggataggcacctctcacttattaatcagaccttgggctatctcttccctttttgagattttctctctgccccacctcccactcactccattcacctcttacattaagaaaatatctagctgacaaaattcccacctgaatcttttgtatgttgttctactcttaaaggatacccattatcaactggtcccctaagtttatttatttttttttaatattcttgccccactgcagttctaacagagttggaaatgactctcaatatttatatatagagagaaagggtgaggaagaaagaaggaaacagaagagaagggaagtctggtcaaataacaggaggtaaaatgagagaaagccattgacctctgtgttcccatacatcctcacaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttcaca

SEQ ID NO: 1071 - DNA, 74326 bp, mus musculus; identical to SEQ ID NO: 1070

SEQ ID NO: 1072 - DNA, 13172 bp, mus musculus
tggccttgcgttcgcctgagcaagggagtagacagcacagcggcagcggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagtgagtaacttatctcctctggacgctggggtgggaggcactccttcagggtgaggccgcacgccccggagtgcatgtggggaggtcttcggaggaggagcggcgcctcattttgtctccggctttttcgagtgttttcctgcgggcgggcggatggagcagggtgcggcggggtggggtaggggcacttggctgggttgtgaccccccgggcttcccaccccctgcctctgcacgtcttggatgaagtcgaggtggtcgcacaggcggagctggggagtccgggcgcccgagagcgcaccggagaactgagtggaggcgagaacgcagctccctccggggcccctgggaacgtggtgattttcgccgagagccgctccaggagcgagcttgactcgggcgagggacgaggccagaacacgggttcctcgtttgcgtagctgtggagggaacacagagcgggacccggcgcttggggtgggtggcagcgccaacatccccactcgggcttctcccattttcatttctctttcttccctgttttcctccctggctttttgctttgctgtctctttttgccccccgcccctcctttctccctgccggagcggtagaaaggcgggcgctgctcccaggctcacaaaggcagcgggtggagaggggcggagtgggagagtggtcgttgggtagtgggggttcgaaccagtgcccgtcaggggtccaatggagccggtaacagagcttcaagggcccgccagggcggagagtggcggccgagctgttgagggaggtgggtggagaaggagcgattcctgcccaggcaggtccccttggcccccgagtctgtcccccagattgggaagctgtgcttagttttccccaaggggttggggcggggagtgggcagctatataaaggacatcctttcttttctttcttctccttcctctgcacaactaccccaccaccaccacacacacaacccctccaaacaacacgcacacctttcagggcggtggctcagtggtttctgggcttttagtgggaagtcgctggggctgttgtagtgacctctggaccttctcttttggcatccaggactcaggttggaaccaagggtcaaaattgcccttcctctcaattttctggaggtcccagcaatgtgcgaacaaccccacttagcaggaaactggggagctttgacctgctccatccgtgatcactgattcctgtatctcaaatttcttcctgtccactcttgctgccccacgccgcctcccccccagccccgccctgccccgggtaacttcccaggctcctgcctaccttggcctcttgggtcccagggacgtttgatctctcagccctggagtaggagaaggcagctttagttttcttctcctcgattaaggtagagtcctattactggttggtgggatggctaaaccagggttggggtggagggctctccctgggtacaaggaaagggattggcaagaatttctttcctacccagaagccaaacggggtacaacactctcctaacagcaggggctcaaaatgctctgggagctctgggctgcttgagcccaggggggaacgttgtgaagtgctcagtggttgtgaagtgctcagtggttgtgaagtgctcagttaccctggtaagggtggaggctggaaatgttctgtcttgagccaggagagttgaaatccgcctggggtagcccatcataggggctcatgggagtgacctaattgctctctcgggtctctaaccagagatagcatgcagctccacagctggaaaggagccctcctgcagagttgggggtgctggaagaaacacgatctgtctgtgcttccccctttttgtgctcagagactttagtgctctggactggcttacaggttttggggggtggtatcctctctgacccccctcctcatctacctcaagctgagggcaggcattgtggggtgaggatggggggtggctgaagactctctagaaactgtccgaattccattctgtaattgggtagatcctgggaaggatcagagactgatcctggtgcaccctccttccatccaggctcaggggtctggaatgcagccactgtctacatgtgttggctcggggtggtgggggcaaatggacaggaaggaggcactgccctcagctctccttgagctttgggggctgcttctgccaccgcgcccaaccctcaggctgccacagcctttcaaataaacagtccctctctgtctccctccctctctgcctcctgcccgagttctcctctcaggcccgtgtcagttcgccctctcataccctccgcgagcagcgctcacttcccctctccagctaggctcgcctgctctgccttgctctcacactccctctcactcttagtcactctctgcctctttttctcaagtccttttgtttctcgcacatgcccgtgctctccctctcaggctcattttctctcttccttcccctcttcctctcctggcttttggtctctctcctcagccctgtcagaagctggcaacccccctcccaaaaaagaaaatctcccagtgcctataaaccctgcttaattgcttccttcttgggaaaaaaaaaatcaaaataaaagaagtggtggggctgggggtccgcttccaggttccaaggtgcgtgcggcccggccccagccctgactgagaggggaagcgggaatggctggcccaagactcccaagcctctttcccaaattggtgctggggccttctgggatgctagtccctgagtggcaggagcttctgcctccttggcccctcctgtcagatttgccccatgagcgcaaggtggggggatgggtttggtcctgctagagttttttttaggaacctctgtgtgtgcgtgtgtgtgtgtgtgtgtgtgtgtgtgtgtctgagttggggggctgttatctaaatggtcctaggcgacccctcccgcagcctcttcccctgggaacttggggcagccggcaggcctcacacttgagtcctcagccaagtccagctgctgcagttcagtctctcagtcccgtcctgaccccttcctgccccccactcaggttcccccacctccagggagtcagaatgtgcctgagatcacattacaaacattccctacaagggggtgggggtgggggggttcagcttggcatccaggacccttgactccagcatgggtgggggcagctgcagaccccaacccatgcttgcctgctccaagccaaagtgttggccccagccccacacagctgttctagctcacagtcctggggaggccagctcagggggcccttttccggggtggttagggacctgacctcttctactttgtggctgattggccacaggtgggagcctgagagtgatgggaatccagcagctcctaaagtcccctgttcccctgcctcccctctcccacatagggcagccaggcaagggcaagaaggacctgtgaggctggggtggggactgaatcaagggttccctttcttcccttgggctctctgttgtctcatccgctcaggtgaatggggatgcgtgggccctggatactatggtgcatcactgttttctggggttagggactaaaggagatagagtgggccagccaggaggctgctagttgccatgggaacaccaggtttgggggagagtccactctgtgactattagaggagctgagatacgggggtgctcaccagccacattctgggttccttaccccgcagaccatagcagcccctcttgggcgtgtttcacgatcattgttttgggtcagggtgctagcagccaggaatgtaagctccttcagctttttacttctaaataatgctgtgtttggcatgctaactaataggcaggcggcaccttgctacttacaatgcattctcatatatgatctcatcgaatgctcccaacaaccctgggaagtaggtattggtcccattttccagataagaaggcatatgcccggacaagggaagtgacttgtctaaggccagtcaatgacttgcctatgggggcagagctgtgttgtgtgccattcattcctgctgccttgaaatgtaggagagacaggaattcaaggtggggtttgggaagaggccctggctccctgcccctgagttcccctcttacctcgcaggtgtgcaagcatctgtccctgtgactcaggccctgtctgtgtggggtgagcagtgctccaacttcctcatttgacttttctaggcctaccttccagggctgactgcttgggtgacctgaactaaaggcagccaactcactgcctggcacactccctgcggagctctgagtggcacctttggttcctctctgagctaagaatctctcttctcagggaccccacagaaagcagacatcgacatcgaggagggggggtattaaattcataatggacacgagccttagccaggtggggcagagggaagggcatagttcagtgtagatggggagggtgacttcctccaggactctcctggcttccctgcctctgacagagctgtgtgtgccaggacccagctgctgttcctgcccacccacgcctgggcgggcactgctgggacatgccaggcctgctcctgccagcctcgggggctgggtggagctgggggagttaaagaggagcctttaatttgggggctccccaccctagctgggatgagaacagacttgagctctggcttggggtctgtcctccattggtcttgccaccctgggaggtgcaggtgcagtggtcgtggggtcactgaatcgaggttgaggctagaggcttctaccagacttgggcttgcatggcctagaaccaggctccccctttggtcattctctgaccacaagttgctagagcctgagagcagggtgacagggaaagaagtatagacctggtgggatgtgggcagctttctgggcaagaccctcctagctgcaagctctccctgccccctgtaaattgtattcacatgggtggagaagggcttatccggagaaaacaaggagggggctgttggttagttggtttctggccagtccagggccttggaggctactgtccccaaccccttcaggcttttcatatcccaggattctttgtggcagtgatggcatcgtggtgcttctaagctaggtagaaaggctgaaggtagaacttgggttagggtagagggggaagagctggaatagcttaggccgcctcccccaagtccttttactccctggggtggcgccctggggtcccagggctatctgaggctggagagggaaggcctcaggggttaccatggtgacctgcttcaggcttcctgctgagccatgtcaatccctttatttttcagaaaagggctttgtctgggggtggccccagacagaaaagcttggcttggtcctagggtggggggaagtaaggtggaggataaagagtttcacttcgggatatctcttcctcctcttcccttactcctactcctaatctggtaagaggggagaactgtagggtccccctttaaagtatgactagtgttctacctagctttggccttcactctcactggctatacacccatcccttatggcccgttaccactctcttgagcttctgacaggtcaagacgaggtttgcccagtggtcgggaagatgctaaggttaccagtatgggggatcagggtcagggaaggcgggtctcatcaggctccgctcccttctgcacttcaggggaaggtgagtttccctctgccagctgccatgcaaatgaactaatgaatatttatgaagtctgttcactgaggttgaagagactctgaggggttttgggggcaatagttctctcttctcccccctcctccatcatgtagacatctgtttcctcaatgcctctggcttcaaggtagaaccccaattagctagaagccctgttccaattccagggctctggaacctgggtggcaatgggagactgcacttggggtagacaggactccctggtgagtaagccagaaccgagtggttagaaagctgagctggcctgtctccctttccgtgccctctatgtagctgcatatatatgtgttgttaagatgcaacagtacaaggattcaggtaatgttttagggcctcttagacccatcgggttattgtcctgggtaggtttagacccctcttttcaatgggaacattcatctgatcattcattccctcacatgaagggcctggactctaaggttcctgctggctctaagatgtgagcagttgtctaatcctgccatctggatggaaccgttgtgagcactggaaagggaaaaaatgcctggagaattctagaggctttggggaaacttgttggctttgtatggtgcatgggacaggggtattccatctgaaatgtttatccaggcttccatcccatgcctacttcctttctgggccctctatagttaggtaccagtggggaggccatctcattctggcttttaccctcctgcacatcaagatggcagctcccaatttggtggagcctcactcgacatggaggaaaggctgcttttcttcgtccacttcatccatgtggtcagtttccctcttcgcctacttgggtatcatttccctccctcagatgaggacacaggtttggcattgcaaaggcatttgcccagagttcccagtaggccggtattgcttgtagtacctttggtgtaatgggccctcaggaaatggaaccactcttttctcagatgattgtggtagcctgtgaactggtgcatgacactgtcagcttcattctctttaagcactgcctgaagccttccattgtccttcctgctctgagagcctgtctccaatgggatgaaacccaccctgcttgctgtgacccttgaagcctttcagtctggccccaggtgaacttttcacctcttcttctgtttctctcttctcactcccagccaagctggaccaatcactggcctgggctttgtgttgtagccactgctgtctactgtctcagtgtgttgacttcttattcctcacctaagacccactttcatcctgcctttcctgtggatacatctctgaccatcctggtcagatgagctatctctttcttctccctgcctccagcccttgctgcttgaatcatcatcctcacacatacctacagatagcctggtgttgtctatcactcgagtatgggttatttacttttctgacccaaactggacagtaaagtccttgacgatggagccatatcttctcttcctgtttcccctccaaaatatgagagtgagctcataggtacttagtgttagtatctgacctcctgcctcttgggagactgcttctaagaggcagtcaaacatgttgaacgcctattgtgtgctaggtgttctccatgtgctgccttgtctccccaccacaatattggaaggtaggggctcttgccacccccactttacaagagaagaaactgaagctcagaacaggcagctcatccaaggtcacagagttagtaagggcctagctttggaatctgattctaaagtctgtgttctttctcctacatggttctgccttgctctcagcaccagcccatccagtctcagaaatggccaatggagcaccattttctttctgtgtgcttaggcaaggacagagtcctatggataggtggtcctgggctgctgaccctccctgctgtcccccagtgcctggccttctggattagaatatgaacctggctcaaaaggcatttgtccatctcctctcaggagctggagtaggagcaacatagaggtgacaggttaggatacagatgaggccctatcttctatgatctgttgtctctggttgagccccttctcttctcctctgttctttttaagaatgagatgaatcaagtttaggaattcaggctcttgcattttgagggtgggatgaattgccagtaggacaataggcagtgggagtgagcagagctgcacctggccagagactgtggccatcatccctttgctccaggcgatgcctgttcctatctttccatcatgaccaagattagtaaggatgggggagaagacatgggtcccagacagattgagctcccccagcctttggctgggagctgcggggagtggtgactaagacatgtgtgggcttgctgtgtgtgtgtgtatgtgtgtgtgtgtgtgtgtgtgtgtgtgtgtgtgtgtgtgtgcgcgcgcgcgcgcgcacgtgtgtatgggtataggagaggtagtagcagcggtcatgaaggaatctttgttgggggtgggggtatataagactgccacctccaggtagcatgggcctgacaccttggtacccagcccattggccacgtcagccccctgcggaaatgccacattaggacaaagggctcccccagccaggcagtgctccaccctgccgagcagtcagagcctggcagccttgcccatgggccaccccttccacactctcctggtagtgtggttctctctccccacccccagcctgaggatggaggaagggcagaaggcttgctcttgccatctccacccagtaggcccagcccggctcttgtccgcttccctggttctggaatggcctggggccacccccaaccctgaggctgaccatcttcttccttctgggcaggttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctgtgagtcccgcccatcccatcctctggctctctccctgggcttaactctttcctctcctgtagtagtgggagcttctaagtggtgcaatgctattgcatgtagttaagaccctgctggatctgatcccctttgaagactggcatgttctcctcttagcctggccttggaattctcgccccaacatttaccaagctcaccttggctccaggggttgggcaggagaggtctccaattcgtgttgcttctctcttattttctttgcccacctaagttctaatattgggaatggtaacatatgccaggccctttgggatcagccagctattcagcctttttcttcaggggaaaccaaggccccaaaaggtgaagggacttcttgccttagatcacacagtgagttagagatagggtcaggactccaacccagttctcctgattcctactccagaattcctttcagtctatgtagaagcccccattatgatcccagtgaggaggcagaccttaccgaggggccatggcctgctcgtgacagaggagcagtgcccctgggggtggggcttgttcttggcctgggctggactaggccattttgttcctagtgggagggaagaaaatgaaaaggttcactggtagatgggagctgcttgcttctcccgactgcagtttctctccctgttggctgaagcagaatgggagtttctgggtaatgctagtagacctttctctcctcctgacttctctgacttctctggcctcttcctgcagcaacatccaatggaagcctggaggggctggaaaaccgggagggcggtgtgtgccgcacacgcaccatgaagatcatcatgaaggttgggcaaggtgagtgcctagtctgagggtcccctcaccccaccctgtttgacctttggaacagatgttcctggctgggtgcatgtgtattaggagtgggggagcaggcgtagggttacagtatccaggccattcttggcccacccttgatgactgagggcacctatgctggccgggtccctgcctctcacctgttctgtctccattcttagatcccaatgctgtgacgcctgagcagctgactaccagcaggcccagcaaggaggcagacaacactgtcaagatggccacacaggcccctggtagtcggggctccctgggtgactctgatggcaagcatggtaagtgtatgtgtttcccagaggtcaggagccattgctctgtcaccttgttaggccctgtccctgaagaaatgcaagctgggcctggcctgaaatctgctgtgtgtccctgggacccctggctgactgttccttcccctttcccttcctcagagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacaaaaaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcactcccagagcagccatggaaggagctggccctcacaccatccacctccacactgcctcctggccagctgcccaccccagtgccaggtgggagagggagcagaacagccagccccttccaggtggcagtcggaagggtttttgtttttgtttctgttgccatttgtgtaaatactagtctttttggaaaaaaaataatgtaaagatgttttgtataaactctgaattattttcttgttgcttttttcttagaaaaaaatgagaac

SEQ ID NO: 1073 - DNA, 13172 bp, mus musculus; identical to SEQ ID NO: 1072

SEQ ID NO: 1074 - DNA, 426 bp, mus musculus
gatgctcccttctcatgagagaccatgcagatgaaactctgcagagttgtgcaccacctatacaaccctgtgagatgtgcctacgacttctgtctcaactgtctctaaagatgcttgccaatccctttgcccttagaaaatggtcttgtaaatatctgctgtcctaacattccaagacttgtcattttgctttatcccatcccattgggttagacctgttagctttttgacatctgcttgggtttaacttgaggcatagagagagagcttgccccagactatatagatgggaaatggagaaaccggtatccaaagcaaggtctatcactccaaagcctatacactgtctactataggcaaggtggctggaagaatgcagctggcaagtgtctgaggttttgtattagcccacaaagggcataatta

SEQ ID NO: 1075 - DNA, 41323 bp, mus musculus
agaccacaaggcccagggattgcaccagaagaacagtcctgcctgcgtgtcagccagcgtgtgggagaggcagcctggggtgggggtggaaggagacatcctgcagacccctgggttaggcccagctctattgagttgctagcccaggggccttgggcaaggctttcccctcccccagccccatttgagaactgataataatagaagctcctagcggggttgctacgaggagtaactggcctggtggatgtgcaaaggcattgcaaactgtaaaatgccgctcacgcctgagggactgttgttagaattgctgcttgtacacatgacctctgggtaacttgggaggaggtagccctggatgtgccatgttccatggctagcgcctcccgtttggggaaagtgggggaaagggagttgcggtggggagaggaggtgaatgggtgcgtccttggggtgggggagagtgggagctgcgggcccgggcagcggcctttcatgcgggggctgaatggtggggtcccgaggcagagctgaggcccgttggccaggaatgccgttccacaaagccgccacacatcgctgagcccgccatgaccacagccgcgcacgggggacccgggggacggggcggggcttctggtcttttctctgggaagaatctccttccaagagggtcccggctagaacacaggatttccatttcaatgctccctggcaagctgccctcccccgaaatcggctgaaggctcacggaaaagcctttaaaaacacagtaattacaaacaattcctcggcttctcctgatttccctccacgcggcactgggggcggggcggggccgggctggcctggggatggggaggggaggggtcatctcctcgcggctgcggagttgtatgtgaaagccgcggctagccagcccaagcactgacccaagtgagccagtacttgggctcctgcttccttctgggtgccctaaggccggcctagctgggtctgggtggtgggaggcagctatgaaagccgagagcaggcgcctgggaaaatgcaccgtgactccaggaagcctgttgtaaatggagccagaacaggaacttcaggcagcattgtcggccctccaccgcctgggcctggaccccaggtgttggcccccaactctgccctacccggtcctcctgctgctgctgagcccacgtagccaagcccctaccgcccacagccgtgggggccagagttaggtgtgtgaacggtggatctattccttaacggccacctctggcctcccaagaagggagagggatagcaggtaatgttttctgagctctccgagcccaacaaagccctttgcaaggactctggacagttctggctgaatctgggggacagcctagggcatcttggctgaagactggcttgcacacagttatccttacaagcagggccccagctcaggaggggtcattttatgcctttaggaagctgaatgaaaggaaccccattaatctgttcaaactggcctcaactaatgtctttgttcacgaaggggatgtgatgccctgggagaagagggacactatttcatgcctctcgggcctttgtctgataataacaatgctcaccaacactcagagcatgtaccctttgccagaagcatttgacatgtagtcacttatttaatcccaaccgtacgtgtgctgaagaaaccaaggcacagagaagtgaagtgacttgctgagggtcacatagctagtagataaagctgggcttagaacccaggtggtatggctccagagtcttcatcactggctctgccatctaatctgtgagaacaataataatgactctattagtgccagctcctgtgtcagccattttacacacatactcgcatgtggccgttcacaacgattctgtcaggtagacttcattgtctccatcctacaaatgaggcagcaaaaacttggagggtttatgtgactttcttaaggccctacagttggtaaggggcagagatggcatttcaaaacccagctctgcctaattcttgacaggcaggctttccttgaacacctttgccactgtttcaaacaagctttccacgagttaagctgcagtgtggtatctgttgggtgcttaggacagaccaggcatttgtttcattttacgtatatcatctcttttgagacttacgcctaccatgtgagggtgggggtgttattccatttgcagatgggaaccctgagtctgagagaccttctctctcgcctgtcctctctctaggttgggccacacccagcattcacatcccttttctttgggggaataacttccccagccacagtctcagaatcctcaggcttcctgctggaaggaaggggcttgctgcagactttatgcattgactaaatgttggagtcccagctctgccacttctgggtgacttgcggcagttcactgccctgtctggggcatgactaccacatcccaggtgcgtgaggctgatcaaatgatgagatgagatgcaaaaacattttgtaaactctggagaactatataaaggtgagcaggggctctgagatgaaggtttccatctctagcattctggcatgacctcattgcacacgtgtccaacacacgcattggcatcaacattgaaacacacataccagcaccagtaggcttcaggcagatgggtgggaagggaggggattgtccttgctcctgagttgtctctcctctaggcagagcatccactagttctttaatctttccttctaggacaagatttcaagactcccctcccccaaggagttagataaagtagaaagatcgtggggttcggaatcctgcagatctgggtttaaacccacgttttgctaatttctagctgtgcgatcttggaaaattgcctttacctctctgagcctcaatttcttcatctgcagaatggacatgataatattgtagtactgatctcaggctagtctgaggcccatatgaaaagtcatgggctaggtgccagagatgcaaatatgggtagacttcagtcctggatatcaagtagcaagggagaaaggtcaagcagcaggcagatggtctcaagtgttgtgatagaagttagccagggctctagagtcccagaaggagccagaagaggagcacgtagtctcagaggagggtgtggcttcacagatacggtattgtccgcactggttcttaaaggggaataataaatagtggttaacactctacagtgcttcatgtgtgtcaggcactgttgtaagtgctttacatgcatgatctaatttattcccttgtaagagaaatacaaccttaaggggtaaaaacagtcttcacccccattttacagatagggaaactgaggcccagagaggataagtgactttcctggttaggcagtcagggccctgagcccacactctcaaccactccaccaagctgcctgtgtgagtagaagcttgccagcagaagagtaaggtgagactatagagcatagcatgaaagcacaatcccttccagggctgggaggtgggataggtgagcaggggccggatctcaagggcctgtgcgccaggctcaggaacttagactctcctctgggggcagtggggagtcactggcagatttgaattggagaattacatgctcagatttgtctgcaggaaaggtctaagtggctgtagtgtggaggctggtccgaggaggacgcactctggtggcagagaaatgataaaggcctggattccggccgtgtttgtagggatggaatgcttgggatggattccagagctattaaggaggtaaaattggcaggtcacagtaactaattagatgtgaggagcaagggagagggaggagcaaaggtttctagccaggaacttgggtggatggtagggttacccctggagaaataaagctgaaatgaagtgtggtgtgggtctggagcaatgaggtgtggtctgggagtataaattctgtttggggcaaggtgggtttgaagtgtctttgatgatgaccactgggtaaatgtctgtactagctgatgcttgggggagtagcccaggctgaggttacatggaatttacttgctgagaggaggtggtggaagccgcaggaggggctgagagagccagggagagcatccgtaggggaggtgacccgacatttaaggggcatactggagaataggggcctgggaaagagactgagaaagaatggtcaaagaagccggaggagaactaggaaagccatgtctgagtagacagtagaggattagggagtcgcaattgtcacatagcaggaagtagtcacaaatatcaaatgtgactgagaggttccacgagctaagtccgctgattcttgtaattaggtttttgaggtcctgggtgacagctgaagtagggatgggaagctgggaagctgtcagcagtggtctgaggtgtggaggacaggtggggaagtggggacagcccaataaggaccctggaaaaggagatatggaacattaactagggagagacacaggatcaaggggggagccaagagcagccgacgggaaagttagtcccttccctcctggccattttgctccctgcctctccctgccatacccccagacttgggtctctgccctgggcgtgctggggtttgtcagtgcctttcaaggtgctggcccctccacctctcttcaggctccctcaagtctcacagcagaaacctccctttgcttgtctctggaatgagcccctaggagagctgatgagacagcaattagaccagttgcaacggccgtgcgttcacatctctgtgccagggcaggcctgctgggaccctgccaaactcttctgagccagccccatagcctggtctccctcctatgtgacccccatggccaccatctaccgagggacctccaaaggcatagaggctggggaatggcctcattaacatctctggcctctgtcagatatggctatctatgcatttaggatccaggtacaaccctacaagccctggggctgggccagtgcccaccagttttagggcagctgagtgaaacagaaagggcaggggcagacttcccttccatgcccctgcccttcatgcctgtgtgactcaagatgttgcccctttatcaggctcccatgtctcccctttccacaaagcctctagaggattccagccttctagaaagaaatctgcctttgtgtgatgggttcgttgttttgggccagcagcatctgcctgttgtgccctgtggctgttgggacctatttttccagaggctttttagcctcagtaggaaggcttcatagccctgggagtcatccatctcacatcactacccccaaccttagtatacttgtctttcctgtttccagcttgcagtcagtggatggcagccccctggctttgccctcaccatctcaaaattgatatatcctagaactatcataaatgttcatttatcctaacagtttttgattgaatgaaggccacaaatacctcggtagactccgcattgaaaagaccatctgcccctctccccagccccccacacctcaccccttccacaaacatctcagtgatttgttctgcgttgggccccagagaaacagaaatgcatcagagatcactcccaccctctccgagctcaccatctggtgggaggcacagacatgtccacaaagcattcaaatgtcttatttgggtgtcctgctgggatattgttcagagtgcagggagggagggaaggcaaaagaggcagccactgcatcgtactgaggggtgttgggagacttgaaaggtaaacaggtgtttggaaggtggacaaggaggcagaggatgcagtttgggaagagactcagtggcatacaatggcctggtaattttgaaggctgtgggttgggctctgggggcactgctcatagtacagatggagacactgaggtatggaaaggatgtacttgtgaggtgatggtacaaaaggaggggaaagctgtgtgagtcacagcttgaggactggagtcactgtgttgggtggcttggcctggtagagatcaaatgtgtgatgggctggggccaggctatggctgtagaataaacttgtattggaggcttgaaatcctgtcttctcatctctaaaatggggataataacacatactttataggcttggtgtgtgggagaaatgacataatgcctataaaagggccttggacgtgtaaagctctctgtctgtgggaaaggttattgttattccgcctgccctttctggcccccaggttaagagctaccactctcaggaagccttccttggttcttcccagctggaagtcggagcctctcttcaggtcatttctccttgcacagcatctgtgagtgcctcaaaggcagagcccatgtctgatttctctccacagagccctgggggaggttcctagaagatcaagctgcatatgcactcatgttcctgccatgcacacacacatggctaaatgtatgagcaaggacaagagtccaggtacccacatttggagatggccctgtgggtaggtatgttctcaggcatgccccacaaaggactcccatctactcttttcctgcgcacagccacattccatgcccacaggaatagcccccttacactttccccgcattcatttgttgacctcaataccactcactccagtttacaggtgaagtgagactgagagaagtcttgtacagctggaaaacctcacatggaagtcacggtgggcacatgctttcccagggcatgtcctcagctccatttgtgcacatgagtcccctaagctggctgatttctgctccccattggaagccagaaggcatcagtttaacctgggaagggcccacagaactagtcactggtgggagggcagtgctgctggcaggggtggtggtggggtagaagggtggagggtgggagacagggtagggggtgttggagttgaagaaggaggagaaaacctgatcaaaaccatgtcacaaaggaggggggaaagggtagggggagagagagagggaaggagagagaaagagagagagagagagaggagagagaggtttccattcacaaagaaatcattatggttaatttaattcattgtagcgtttaatacagaaaagcttttctacagagactgggcatcaggccaacatttatatataaatgggttttattttaaaagcgaatgcagtgagggggataggctggagttagccctctcactccctcttctttcctcctctctttatctacctttctgagtctgtgtagaccaggaattgggtctcccacaaagcaggaaccccctactccccactcctatggcccagaatttctacccccaagaccttgtttcctccactttctcaagaccatagggagaccctgggctgggcccagctgagagctttgctgggacattaaaatctttgaatgttctccttaagataacacttagagaccactctaccttccttgtccccatccagagcacactctacctactgcacagatgaggacactgaggctcagaaagggggcatgacctgactgtgggcatacaacttcgtcagtgacaatggcagaacttgaatgtgggttttctgtttctcagtccagtgctctggaaggtgcagtccccctgtgccagctccttgggggcctggcactcttcctctgcacctgagtcaggcccagatctatccttccaggctctgaaatgatctcccccacccccatcactcctggtactccagcaagctaatcaactaattcacactgtggtgtcaatggcaaataataacttgctgtaaagtgctaatggtgcaatttcaggctctctgggcttgttggagactgaaaaagagcttgaggatgagggaagttttaagagtccatcatattatattacacaccatttatccaatactctgtgttgccacatactcagtaatgcctcttggtctgggatcacagcttaccgccataggttgagtggcaccgctcttaatggaatatgtccaaggatgcatccagatttgcctgcccaaactttcctcccagcctctagttcctgcagcagggacccaaacacacattgccagtccttttccttctgcttagcatggccgggccctgtgggagaagaagcaagcatgtaagagtgggggcgggggcaccactccagaggtctctggagagttgcctcctttccctctgagccaccaggtgccaggttcagctttcagggctgggatctatttttcctcacatagcagaactgcccacacatactcccattctagggatgaggtaactgagccctggaaaactgaagtgacacgcacccaagacttggcactcaagtcttgtgatccttggacgtcatggctgcccaaagtcccctctggacaaagagggccagctcaggctggggacagaaccgagtgtggtggcagtgtcagaggatagggcttctgagtccaacaggagcacataacctcttccatgggcctcagagctacccaccaggctcctcatctcccatggggaaagagctggggagcctcgcagctaagcaccaggaccaagcacagactcaagagagaggagaggcctgggcccaggctccagatcttgccctcaggcccctggagcacaactggagggggcttgagggtggggtccaggccctcgatgaggccgggagtccccagcatgcctcctgcacgtccccaggtctcccggtggcctggctggtatttagggtatttggggtccaagcccagaggactcctacatctggatcccgttagctcgccgcgttccttcttggccgggaagaatgcgtgcagcgccggaggagctgcgggactgcggacttgcctcccggaccaggctatcaaagcaaagtggcgggcagcctgcccctggggaggagcttcgcgggctctccatcttcgccccgccgccgccgccaccaccgccgcagcctccacggccagtagctccggggtggagcagaggcctttcagcaggcgctcgctgctgcgtaggagcgagtcaagcggtcaaggcgcagcccgggcagacccgctgcttctgattagctgctcacccgctgctcctgccccaccgacctgctcccgcagccagagtgaacgggagccgcccagaggctccccgaaatccaaggggccccaggctcctagccagggcaggcacaagctgacctctgcatacctccaccagcttcaaaaacaggcactcacttgttctttcctctccaaatcctcatttgctctcccttagagcctcctctctgaagaacaccacgacaagccttagttagaggcagttatttaaaaatcatactgaggcatgtgcagcctttaatagtgcagatgcaccttaaggttgggtatgttcacataaacccatcataagttgaaaatatcataagtcgagcattcatttaatacacctcacctactgaacatcctagcttagcctcgcctacctcaaacgtgctcagaacacttacattagcctacagttaggcaaagtcatctaacacaaagtgtattttataatgaagtgttgaatatctcatgtattttattgaatactgtatcgaaagtaaaaacaatggttgtatgggtactcgaattacagtttctactgaatgcctattgcttttgcagcattgtaaagtcaaaaaattctaagtcgaaccattataagttagtgactgtctgtgtagcatagtgtttaaggggaaataaggggaaatgtttggagccaagtctcctgaacttaacttttggttcactacttagtagctctgtgacttagggtgagttacacagtttctttgtgctttaggtctcccccaatccccctgtataattgtgacaaccataagtccctaggtcacagggttgccgtgagacttaaatgagttaatactagaaagtgcttagaatagtgcccagcagttagtgagcactcaataaattatttgtgttacaaagtttgtttataaccattgactcatttgagcctccagcaattctgtgacctaggggttgtaatggaaagctagagaggggagggccttacccaaggttacacagcgaatagtggcagggttggaattgcactctgcaggtctctctgtcctattcaccgacacccatgcacctcctggcattgcccatggcagctcagtcaagcaacagtgggaaggaacttttttctccaggctgcagtccttaattttgccgtatagctgatggaccaaggggaacaggtcaaggatttctaagtgtgagttcagataattgctaatccccctgagccagccatggctgcagagtgtaggcctccaagccagtggcctagacctgcctgaggtcctgaacagacccatccagagtcccccaagactcatctctctaagagggcaactcacctagtgtgagtgagaagccaggagcccatgaggtagtctaagtgcctggaaagggcttgagtcctgatagttgtgccctggcagtggagaggggagggagggtaggagagccagccaccaacgtggttgattgggtagtcagctcagaggaggggtaggatagcaggagaacccctgaggccaccctccagccagaagaatcctccccttctcccttggatagcctgggttgccttctgtagccatcttgcactccccctgctttccacgcagcctcatgcctgcctcagtgctgctagagtgggtaggaggcagcagagaaataggaagtccttgctctgtcccctcctggactgaggctctttctcaggccctgcccatagccaacagatctgggccagccttgcagagagctggcaggaaagcctccagggaatgtgaccacagctcgccctgcctctgcccacgaggccgcctggcaccaaaggcctcaagcaccctttctaaatcaagctcagagatttgtttagattagatagattgagctctagaggtgggaatgaggaaaggagggagagggagaagagagcccaagagagtgccgctaacagagtcctgaaggccctgctgcgatcctgaggagctgctcaaacagcagtgcagtggcttccccacactgtgggtggggggcagggggagagaacagccagaatcctgggttcgagtcccaattcagcctgttggtaggtgatgacatcggaaaagtcatttcctgcctccgagccttcaggtccccatctgtatttggagatgatactgcctgtgtctcagggctgaggtgaggatgaagggcacgatacgtggaaagagcctggtgcgaggccagcctcgaggaggctcaacacgtctcccccacatgcctggatggccattacccacgccctcagcacagaaggctttgttggtctagggttgctctgatacctatgtcctagcatcccttgtcctggccacttgccatttggaagctgcccatttcccgtccccctgccccctcatttcttttctttttttctttttctttttttttaaattttttgagacagggtctggctctgttgtccaggttggagtgcagtggcagtgatagtggtgtgatctcagctcactgcaacctccacctccggtactcaagcaatcctcccacctcaacctcctgagtagctgggactacaggcattcgccaccatgcccagataattttaaattttttttgtagagatggggtttcaccatgttgtccaggcttgtctcgaacgcctgggctcaagcaatctgcctgtctcggcctccccacgtgctgtgatttcaggcgtgagccaccctggctggcaacctgatttcttttgaaggaatcacctctccctattttatggtcttactggggtgtaatctaagataactgcttcaacttaaggtggttgagggggctggccatgagagcaagggacataatggagaggtggatattggccatgagggctgtgtggcagtgacagcatcctgaccaggcagtgctggttacaagacaggcactgcacatcctgtttcctgaaccttggcttccagtggctctcaagtctggctctttggttcccatgagttctgtcagtaccctttccatgagtctcggtaccaatccctttgtagctcaagttgactggagtttggtttctatatgtgccatcagaaccctacctctttcaccaccccccacagactgtgggggcgatactctttcctctggctccccatcacccctcccagggtttagcatgggccacagagcacacacccatttgctgacccctggccccagacctggagaaagggagacatacattgccagagatcagggagaccctggtttgactggtgtgggaagaagccatctggtgtggaggtagaagtcacaacgggatgacgtctggtggtgctggtcggcctcagctgagacttagccaccctcgacaaacacatgttcagtcctagcaaggacctggcctagagtaggcattcagttacttcttcttagttcctgtcttgtagttgtgccactgtgggatgaagaagatcagtgaagaagtgtcaggccccacctgcaggccaggccagggctagtggagcagtccaggaggggcgagggaaagccggcactttgttctgtatatctgcacacatacatgaataagtacagatagacatgtagaattggtttctttttttttttttgagaagcagtcttgctgtcacccaggctggagtgcaatggcacaatcttggctcactgcaacctccgcctcccaggtccaagcaattctcctgcctcagcctcctgagtagctgggattacaggcacctgccaccacgcccggctaattcttgtatttttagtagagacggggtttcgccatgttggccaggctggtatcaaactcctgacctcaggtgatccgcccgccttggcctcccaaagtgctgggattacaggcgttagccactgtgcccagcctggtttcacttttcacaagtgggatctgacttcacgtgcacccaatgttttacagctttttaaacttaatggtagccaggcgtggtggtgcgcgcctatagtcccagtactcaggaggctgaggcaggaggatcacttgaacctaggagttcgaatccagtctgagcaacataatgaaattctgtctcaaaataaaataaaataaaaataaacttaacgtatgtgtggggcatctttccattctgcatgcattgatctatcttattcttttgaccaactgcattgtattccatagtatggaatagcttttaaaaccagccccctaatgatggccatttaggttgtgtacaatttcccgtgcatgagtgtaggatggctcatagaagaggaatgctgggttaaatagttgtattttatctaacaacttggtcgctccaactagactgtaagttccagcagtctagggtcagggtattgccatttctatatctgcagcaccaggagagagggagggaagcaagaaagagaataaagaagcagttgtggaaactttctggcttgtaggtgggaacaagtttacttttcacctggttttcctggggaaaaacatctcggatcccaattctggccttctgaggacccaaggcactgaatcaggagccatctttctgcccctctggatcacacccacacataggcacatgccagaggagtgtgccgggctaacctggcgtggttgagctaaggccagagccaaatcgagccgggacaggctcgcaggcaggatgtttgggcagcacctccagcttcccttctgcatggccctgggacctgcattacctccagcctcgggtcgttcccctccctcctcatttgcccaccagagaccagggtctcatctccccctccaccagggctgcataccttcaaaaagctcgcccaggcatgataggtcacggagtctcgagagcttgcggagtacagagcacctggcagggggtgggtggagtggaggccagaagctgggaatttttccttagtaacaacctggcgccccaactcattggcagttctgcctgcctgcaagctggcctgcactgcctgcctcctgcaggagccttcatcttcaaagctttttgggaaacagttaattaacccccacagccctaccgcctgcccaggagcctgccagttccctcatctctgtggggtgaggaaaaggtggggggcagtgaaactgaagtgtgaagaaaagatgtggagctggaacccaagtgatccccggcccccagacaaagaagcagctttccttttcaatcccccaccccgcccctcaaagagttggtgggatcccccatagaggccaagggactagggtttaagaagcttatcttcgagcacaatttttggaggggatgtgtcatatcatttctctgtgccccagtttccccatctttaaaacggatattaatagcacctagttgtcggaactgtgggaccaatctaatgggacaggggaggggcaaatgctctgggaactgtgtgtacaaatacagcttggaagaaatcgggagtatcagggatggaagggggtgccgagtggaagagaggggcctgaagtggggcagtgggtgggtagtcgagctccttgaactctgtaaacaggggctgccacccagcactgggaagagggagagaggagctggcagaggggagacgggagcctttctccctgccacctgcttctcttgcctcatcttaacccactctttttctcccctaagattctcatgaacatgtgcacacacacatacacatttatcctatacatgcatgtgcatatgtgtacacagacatgcaaacacatatgcacacgcactaaggcacccaaatgagttggagcggactgtggggggtcttgtgacttcctatgtgactgtgccacacaaagacgctcttgcccaagtgtccagggtcttaatgaacacagggaaggacaaacgggaattgggtggtgagttgaatgccaaatgaaattatctccttcactaactctacttttcctacttttttgttttctgaccatccccaataatttgtgtgtctctttttaaggacgagtaccacaattcttcttctgttgcgattgttctccacatacgagactggaagcttcctaaaggcagcaacagggtcctgtttctgtgtccgcagcccatagcacattgagaattagcatgtactctgtgtcttctctgtgcttggcacactgccgtgcggctgggggtttaatcttcacaccaaagtgtgaagtcaatgtcatcttccacattttacagataaggaaactgaggcttagagtgggaaatgacttgtgcaagggcatgcaggtgaagcagagccaggattccaacccaaagccagtgttcctcttccccctcttacagcacactgccttttctctgggagtctctagggggttccctaggctgggggtggaagctgggtgaagtcaatgtctcttctggagtttcagcataagctagcagcagcctgacttggaggactgcttggcctttagacacctacatccgctctgcccggtctgtgcaaggagctcggaggcagcagccattttccctgcataccaggagaggcaggtgatggcaggagaggagggaggcccagagagggtaagttctggccattggcagcagagcctggaacaggatcagagctgagccaggccccatgggggtgcatcaggtgagtcggctggggcctgctggtgtgctaaccaccagtctctccagcctcctcctccggcatgggccctggggtcaggaaggagggcccagagcaccactgagaaaccgagccctcctaaagccgagccaggggctgggccactgtgcctgggccctgtgggcggtggagggggcagtctggcgcctggtaggaggggcagccaggtgagcacccctcagcctcaaggaggagggagctggaagtccagagggggaggcttgtttctctggaagggaaaccttcaaacactaattggtagttgcaagtaattaaagtaatttactcagattataaagaaatttcttaagagtgattaagcaactccggctgtgtatggttgttggtaatcacttccccagggggattagtgcacttggcagggtgtgagaaggatgcttgcacgggatgggtcctgctttctcggcatgggggagagggtcacggaggctgcaggggatgttgggggactactgagactccccagtggagattgagatcaggtctgagaatacaccgaggtctgtgtgtaccaggctccctcagagactcaggtgtacacagacagatgcacgtgcagacatactcaagtgtgtgctctacatatatatgccattacagatacccctagacccaggcacatgtggtggagatgctctcccagatgcacaaagaccctgatgatcacactcctgcaggcacagtgactcgtataaattacacacatgatattatacacacctgggcacccacacgaatctgagtcaacagtcaacaggcacagatactggtataggcacctgtgtccacacccagccacacccggacactggaaagattatctcacgtgcttacaatcctgcacacacacagttgtagttacagatttacatggagaaatacacgtccatagacacagtggtacatgtggatagatacatgtatacaatggcacacacgtccagacatctgtttccacccaggcaaacagagcctcaagtgcttggagtcagacacatgtacagacctagggtctcctgcacaattgcaaatcgactcagacacccagtcatcctgcatgcacgcatgtgcatatacacagaaccatacctagacaagacttgcacacagtgcctgtcactgacacctgtctgttccacagtgtgctgagagctgcctcctaagtcctctgagtccttagaagtggctgagtcagagcctgtgtgttcccaggagcactgagctgtggatcccccacctggccattcctatcggggtcaagctaggtgaattggaggtgggttggaggtggaaggggaagggagcatgggccgggctggggcctggctgagacgagctctgaggagccctctgaggcaggaggatggaggtcataggacacaggttccaatgccagaacagcactttctaaactaggtgacctttgccaagtctcttcacatttctgacacttagtttcctcacctgcaaagtaaggataatcatgctgccttcttcctaggtaggattgctatgaggatggaaaaaactgaccaatgtgggggtattttactcatagcaggccagcagcagatgggaatatccttcctttgcccctcagaggacagcctaagtcacccttagctaggggaaaagctcctctgaccccaccctgtgtaaagcaggccaaagttggttctgatgcaccctctaaggctcattctcagaggcccaagccgcaggccctcagggttggaaacaaaaagcatggctgaagccctttgagccatcaggaaccatggcctctgcttctggctcagtctcttactcactgtagaaccttgaggactccccttctctggggctcagtttccttctttgttccccaaaagggtaggaacgggggaggggatgacctagatgatctctaagctccctctcggcagaagcattcgagggtccatgtaaatgacacacttgagtctgcttgagcttgaatggtgttaatcacgatgcttattattttgccctaagacagtctgtgctacccccagactctattgatggtgaggagcgatgggggtgggagctgatcatgagggcaccttgctagggcacacaggagccccaagctcaggcataaaacagagaatgaagttaacaagcgacgtccatggaccatggaagaaaaggagtctgggaaaggcctatgagaacggctgccccagccccatttccatttcaatgaatgccaaaagcaactggaactatactctcttgaccctttgaggcttcctcttggttgttattctggtgacaccccccactctttacttgtttctctgtcctgagtaaccgtaaagttaaaacacaaaaggctgtggatttgttgcaaagacaggagggaggagagttgctgggaacgttttccttttccccagtgggcaggggcttagcaggtggggcggagcaggtggggcagctgagaagcagaaagagagctgaacccattgcttgtggcttgtggaaggaagcagaggcccccttgaggaagcagtgggctctggagtatgccagccacaggccccatggatttctagctccccctgcctccctgacatgggttcagatctcctcactattttgtccttcattcagccatgtggattctaacactcatggagcacccaggtgcatggcaccatctctgggcacaagcacatatgttctcttgtttcagcctctcaatagctctgtgagagtgggactagcctccttgtatctcaaggggcactatcttggcactggcagagaaccctggatgccctggtggagctatgccttgaatgagaccaaatccattttcagtaactgctgagcctagggcccttacacctattctttttggagtcagaaagggctctagcatagacactgccctcagccagccctggtaccctgggacatcaagggtcaaggttgcttgggtcatgaggaacctcatccatgctggcctggcctgatgcagcagccttgctcctgacaagtgccagtaagtcagtgccacactcttccccacttccctgtccaccagcagcagtggcccaacttgtcactgctctccttggaaactaaggcttctggaacagtggaaagagcactgacttaggagcgagacctaggctcaaatcctggccctgtcattgctgtctgtgtgtgactttggacaaatcacttcacctttctgaatgagcctcaggttggttcctaatcagtaaaatgagcacaataatccctttgcttcaaaggctggccttgaggggtgaatgaggtcgatagattcagaagcaccaggggcacatcctgatctatagttggtctgcagtgaggaatggggccattctcctttggccatccacagtctcttagtggagctcccagttcagagtcccaaatttctatcccagggcttcacaaggccctcttacttcctgcttcctattcaggtcttgccaaagtcttgcccagtaccgcttatgctgttgccttcttgctccctgagcctcctggggccatcgtgtccacgccttgattccaaagagaagaatgctttgcccagattcagctggaatggaaggtgacctgatcttagagctttctagagagaatgctgcacacccaaatctagggcctctgatccctgcgtcactgagccctctaggtcagaaacctcagtctcttcaactggagttttcatctgctccttcttatcctgctgtcagggaaaggggaaacagctggttcccatcctcagaataataagcccgccgtggaaatcgttttccaaaatcattaggccacaaagattctattcagcggcaatgtttgcattggctccgccctcatttcccagagactggaagacattcactcacagagacagtggcacagagatacacccgagaaatctcggttcagaggcctgtacagattttcctagaggaagacagagcctggaagacagtctctgaagggccaggaaggcccctcagcccagagacctagagcttaggaaagatttggaatcttcaccctttttggaaggacccttaacagctgcccagccacagaagcaagaactaggttggcctgaaactttccaggtggccgcccttgtgagaagagtgaacagaatggatgaaggggtacccccaggtcttgggggccttgcagtctagttgaagagactgcacacacccagacacacacatagatatgcacgccaagtcaaataatacaagggacttaataacaatgcaggagatgtctccagacagcatgttgtctgtgccacatggaggggcttgttagaagactacagagcacggagaagccacacagtgtcctcttcttggtcaatcctgccacatctacccaaggcagtggggaagggccattttcctctcctggccacaaagagatgatcatcaccctttggcattctgggagatctccttatggaccagagcttaacctggaggtttcccggtgaattgggtcaagtggtagcaagattagcctcttggccacctagtctccctctctggggtgttcgggtgcactacgtggataaggtgttagggaagaccatactgtctcggtgagattcaaaggtaggaaaaggacctactactcgtcatggaatgcccaccatgtgctgggaattgtgacaggcccagtgtagaaatatgtcatacaatcctctgcaaagtacgaatgtttagcccattttccagatgagaaaactaggtgcagggaagtgcaaagactttcacaagagcacaaagttggtaagtgactaccttcattgtcaccactgctgcttccactaccattatcaccagcttaacaaaatccatcatcgtcaccatcagcaacaactttaactatttgtcctattactgttatcaacaacaactaccaatatttccagtcataatttccactcactgttgttatctatttcctccaccaccttcgctggaatatatttacttatttaaaggcccaattgccattggtctctggagagaacagcgggaggccaatcccggcattctagttaaaggctgataaactaacacagacacaggcatttgggagccaccaaaaccagtgtgtatacctgtggagctattgactgtttgtgaccatatgttcaggtcaaaggccagaaccctgccaaggtcaagggcatattgggccttaaatgggtcacatgctgttaccctagttgatgtgggtactgcacccaccacacctctgcctccaactgtcccctactagggctggaggccctgctgaaggccagggaagggactgataaagaaggggtacacttaaagggcacttgggggtggtgggcagtgctgagagaaaccacctgctagaagtgtagctcaggcctgggggttggcggcccctgaagccttgaagtttgcttgctcccacggctctcatgaagacctgtgcctgcatgtccatggtgaggaggtgactcatcccgggctccagggcaaggtgtgagaggcggcctaggacatgccttccaaagactctaatagggtgtgtgagtatgtgaatgtgtttgagtgtgtgtgtgtgtgtgtgtgtgtgtgtgtgtgttagcggtagggagatatgtgcctctttctttctgagcaaaccttgggtaccggggataggacagtgccagttgcagactagggggagtagggggctctctagctgaggaaaaaccttgcaatcccaaggcactttagtagtcttcactgctcagatggcagcaccaccctctctgctccttgacctgcaccccatcaattcagttatgttggaaaggagagggactggtcataatggagaatggcctcagggatactcatagccttccagtgccaatgagctcctttcctcattctcctggacaccagttctagctcaggacagggctgactgttaaaatcatcctctgtatacatgctggtaggatgtctggaataggctcaaaaataatccttggatgaggagtaggttggggtggggatagaacaacactggccatgagttggtaattgttgaaactgggtgatgggtacatacatgggggttcatgaaactattctgtctacttttacatatatctgaaattttccataataaaaagtgaaagcaaaacagaacaaaaccaagcaaaaccccacaaacaccatctatgtattgagctgaaatcatactttccagtggttttcacccacagatcccagatatgccttctcagaccacccttattttctctgccccatgtgggtcttcagctatttggacaaaagtacagtctttggaactaagcagatctggcttgtgtgctgctggctgtgggactttctagatgtgtgaccttgtgcaagttactccacacctcctgagtcaaatgagagtgagaatgcctccccttagggccgctgttgggggttccatgtcggtaaagccttctcccatggtgactaacacagagtaagtgctcagcgtgagtggtctctgcagaacattgctattttaggccaaggctcatgagtacccttggataggggaaatggccgctgtttctcctaccacttctcacatgtggccgttccccagcctgcgtgaccttccctggctgtttatcaatgtgccttggcaaatgtgggcctacaatcaggcgccatattccagatggtctggacaggcaggagtacagtagagctattacctctctgtatctgaaaactgtatttctattcatacagactgagatttcattagcttttttagccaccacgtcacactgttggcttttgtgaagcttgtggtcagctcaaagcccttggtctttttcacacatgtggctgttaaggtctgtctccctagcccgtatttgtgcagttgggctttgaatctcaaagcaggacgttacatctacccctgttcaattttatctgactggttttggcccctgcttccagctggtcaagaattaaaaaaacatttttttttcaatcaacatattagctgttccctgcagctcttggtcttcagagatctggtggtgaccaggccttctgtgtcctcctccgaatcactgataaccttggtgtgcaggatgggatcaaggcccagggccctgtggcagctgctaaataactgcttccaggttgacatcagtcaagacaccttaagttcaactattcagctactaactcaccttgcctggccttctccagcccacagttctctatctcattcaccaggacagcgtgggggtccttgtcagaagctttgctgaactcgagaccaacatagtcacaatatcaaatgaggcctaactggcccggacatgttcttagtgaatgcactgcttccttatgttcccagcttcattcagaggtttcctgacaaccagcaacttagtacttcttttgagaattttgttaaagttctagactgagcaaagcggcttgatattgccaaagtctacatttccctattttggagaattgttgctatacttgtaaacctcccagtctccatgtgttcttagaaggataatgatagttctaaccttgtatctgcaattgctgttggtacccggacttggagacgaagtcatttacaatgataacaagagcattcaacatcactgggctggaaacagtggcgaaccagggctgagcaagatgtgattcctctactcagcaagctgcccatctgtctagtaggagaggtaagccatgccaacaaatagttttaataagagacagaaggtggcaagtgccagaaaagagggacagatacagtgttaagaggtttagaggagaaagagctgagaggcagctgggaggtgataagggaaggctttgtggaggaggttaacagttgagctgggccttaaggcatgagcaagatttgcatatgtggcaatggggtgaaagattttctagttgggtggaagagcccaagtgaaggcatggaggtgggggatcttgcttgaggtctgtagcatgaaaaatgaggagtaatcataatagctgctatttattaaatatttactatgtgccagaaattgtatcaagcaatttacacacattatcatggaatcaccatgccccctgtgaagtaggtagcatgatcgtttttattttacacatggggaaactgaggctcagcaacgttaaatgacttgcctagggtcacatgactaggatgtggcagtcaggcctttgagccagggctgtctgactctaagacacatattcttaactaataagtcattcaggtctctgtttctcagccctttttgagcttcaatgccctcttgttggtgtttgcttttccttctcaatatacaactctttctgggatagagaagccagaaggtagaagaactaggttgtggacttcctgtcagtcttcttgctgcctgacactgtttgctgccctcactgcttctgactttagtcctatgttaccccattctaccatggcttggttctctgccctaccttgcagccttggtgtgtaatcttgccatttctgagttcctttggaaaatccttctgttgtgcttcttacttccaataactgccccattttgtcagactataggcagttctaccattcaagtccaatgtctaggtgctcctatgcctcttgagcttttgagccatcttctttttgagggtgttgcgctatgagataatcttctctcatcctccactcctgttcttttccctggcttctctgaaccctgagttccaggtgcccagggtccatgccctcttgatgagaaacagccctgagcagaccttctcactcctcttagggtacccagaacctctgtctccccagctaggtccttcttgtgggccagaattgggcccagaaaagccaccggcctcccccaccctctgctctctgagaggccgatggtcaccaagggccaccaaggaggggcagccgttccccttctagcaccagaggcctgacacccacagcaacctgtgtatgtggtgtgagggtatgggagggcatgcgtgtgtgtctgtgtatgcaggagggaggggatgaactggaattttgaggatgggagggaggaggctgcaaaggaaggtgtgtgtgcatatgtgcatgtatgtgcacatgtgtgtgagtgaatgtgtgagtccatgtgcaggggtgtctgtacctttcacaggatgattccctttcccctctgtcagatccttttccttctgtcacaggcttcaccccatcaggccccagtattagcatcctggttctatgttccttcaggggccagcattttgagatctctatggcttttacctgtgctccgtgcttgtctcagaggagcaggaagccctcaccaagaggcctcctctggcccaatgaaccacagcaccccagtccaatcctctgccaccatggccattccatctcctcacttgactaagctggtcccatcccctctttttcaaaatgaggcaggacagcatgacgcaaacagccctctctctctggaggcaggagaactaaggctgtggcctgtagcccccagagcagtctttttcaaactgcgtgttgcaactcattagcaagtcatacaatcaattctgtgagtcttgatcaggattttaaaaaatggaatagagtacatcccacgcaggccaggtgcagtggctcatacctgtaatcacaggactttgggaggctgaggtgtgaagatcacttgacgctaggagtttgagaccagcctggacaacatagcaagaccctgtctctacaaaaaatttttaaaaacttagctaagtgtgatggtgcacacctgtagtcctagctactcaggaggctgaggcaggaagattgcttgagcccaggagtgcaagccatgatcacaccactgcactctagcctgggcgacagagtgagagtcttgtctctaaaaaataaaaataaaatgagtacatcccatacggtaaggataagtagtttcacgaagcttttgtttccattttatgtacacttatatatttttacataaatgtgtactgagtcttgatgtaaaaaatgattttatacacacacataaatattgttattgttggttttgtaaccatgagttgcaatgaaaaatcaacaacagcaactcaaagcactggtccacagtctagctatgggaccttgaacaagccctttctactctcttgtcctcatttttctcatgtggaaaatagagatggtcatcctttcctccctccctcattcataggggctaggtctccatggcatgcctctggaagcactttgaagactgacacatgctgcacacacaggagttatccttctcactatgcctgccccacatccttttgtttcttcctcagggcctcactgccacttggcatccattgtgggctctgcgagggtgcctccagtgtgcagatcctgggctgcaaatgggaaggcgtagcacgcctgctctgaaggagcttcccagatcctcccacccctcttcctggcaggaagtcaaagaggagcagccaggggttcatcttacctggtggaacagcagaaactgggccacctccctcttgctagtggacctggccaggctttcatttccccagaaagtggagctttagaggacacccagaggataacttcccaaggggctaggtttgcaatatcaaggtggaccggaagagagggagctgcagggtccccatcacaccgcccccgcaggaggaggccaagcccatgggcagaggcacacacacccgagtctgatgccccacgttttattactttctagctgcgagagcataagtctcatcattttaagcctcagtctccttgtctgtgaaatggacattatgagctctacctttcagagctgaggcgaggcaccagtgagctaggcggaaagccactacacaagaattatactgggcctttctggtctcctctgagcccctgtccaggcccttccgttttaccgcggcagagagtgcagaagagatgcctgcatgcatatgtgcatgtgtgtggctatgtgtgtgtgagcttcgtgtaaacgtggattgttggtggggtggaacaatatttccaacccctcaagaaaaatggcttctgtctcttttcctctgccttctataggcaacatttcatctcaaacccaggaacattgtttccctctttgcttaaagcaggaccagcaccccaggccctctcaccaggacattgggcagagcatagaaaagtgtgtgagtgtgaggctgaggctctggcccctgcccctccgtgggtggcatctctgtgtggcctcttctctgagctgatgcaagggggctaagccttgctcagacaagccagatctcccggcacctggggcccctgggaggaaggaggggatgggcttaggaagggggctcctgctcccagccctgggctgccaagcaaccctgaggcagtatgtgtggatggacaatcaggcccagagctgggaatatgcagcgtgtgctcatagagtcagtcctattagagatggaagagacccaagttggcactaagccccactccagggagtggggcagaaaatgggaagtggcctgcccactccatgggagggcctagggtgggaggtcagcacccttgcaggatggggcacccactgaggtcttctgtagctcatcagggccgtcctccagggccctgctccctggctcagcctaactctcccagcgcagctcccaaggtgggtgtccctgcactgactggccaaggcattctacttcccacccctcccctccccttccagctcctgctgccttcctgctcctccttctcttccttgaagcctacttggctgtttacacctcagagatatttgtagattactatctcgggaggcctgactcatccctgagccaagccctgtctgttggatcctttcatcttcctctcgcagccaatgcctcttctgcctaaatcattttctctctccctctaaatgccctccagcgaatctggctcctgctcctctactttgactgtacttcactggagaattcttcagtggaacccacatgccactgcctcccagagcaggactgagggcaaagtggcaaaggccacctgaggcttgctcaagggcttgggtcagcagctcattcactgccccagagtttaaagtggttttgctttcctgggccttggtttacccttctggcaaatgggcaacagtaatctcagcctcaccaatgtcacaggcctgtggtgagaagcaaaattagatcacgtgtgtaaacagcaagccctacttgagtgaaactggtgctgctatgacctgccaaggcagtcgctgtcctttgataactccctccaggccccaggcccagccttctcacaccttctgcctcctcttctctgtctctgtctctctctgtctcttttttgatcatttttgccccataatccctgccgcgccccccccccccctccgaactgccccttcatgtcttggtagcaaatgctctttcccaccagctgcactgcccacttgggctggtattgcccccacaccgcccctggcggggaaaggagcaggcaagcccagggccgcagaccatgaaacctagaagacagtctgaccctaccctcagtcatccccagagatgagaaggacctgggcacagggactagccccaggcttttctccaagtgccttgtccagagatggaaaatgaatggcttagtggcagtgagcgaggtggatttacttacatagacttttcatgttctttatacaaaacaaactagtccctgacaattttcttcttcaaatgttgtcctgctcccctaagagctgtgtcttgaggtgatctggactcactccctatgcatgggcctcaacctccccatttgtgcagtgagagaggctggactgtgtggctcccagggttccttcagctcagactgtctatgtcaccccatcagatgccatattctcagccatgtctcccaagaggccctgggggtttctctcctgggggtcagctttgggtggcatcattgtgatgcattggacctcaccagccctgcttcccaggaggttttcaactgggtctcttactaagaaagcccaaagaccaggatcctagagagagctgtcaggcagaggccagcatggacttagagagcatggcctaagagaagccaaagagcaagccctctcccagggggaaatgatggcagaaagtcctgggttcaaatcctagcagctctgccacggactcactgtgtgaccttggacaagtcacttccttctctgagactaagtgtcctcatctgaaaaatgaggataaaagagtctttccatcacatggtaaaaagggttgctcagcagaggagctacaaaaggttgcttccttccttctccaatcttccccaggatcctgtgtgcaggggctggtgccctcctccttcccctctttgctccttctctgtgctgggaaaagcagccatgggcctggtcctgctcaaaagcacggccggccagcccactgcggggccaggcttcacacttggtgcttccgcagctgatgaaagcctcttgggagccattcaggggagggaaagggagagatggcaggggagggcagtggggcagagaggaagagagacagaaagagaagcagagagagagaagacatagagaagatagaaaaagacatgctcagggacacagagaaatggacccatctagagaagaagacaggtttggagaaaggcaaacagagagagagaaagggacaggcagagaaataaagccagagacacacacagagggagacggagccagggagagggccagagagacagacagacagacagtgggtccaaagatgaaaacgagagacgaaggcagacagaaaggccagaaagagaaacagaagcaggcagaaagagaggctgacaccaaagagagaaagaaaccaagagacatggagacagaaagactgatggagacatagaatgggaaggacagaagggaggaaggagggaaggaaagaaggaagggagggaaaagggtgaggggaggggagggagttgttagttcagggctgagcctgagcacaattggctgacacagcacattctcctacactctcccctctccctcctgctgctgcctccagctgtcccctccccctttccttatcactgggtctttggctgggaaaggggccctgtggcctgcttgtttcacacattcttctaagccaaggttagctggtgttcctagcccctcccctgccctcctccacctactcagcagctctagtgctcaggtagggaggaagcaggtgaccaccccagggagaaagggcaacattccaactcctcagcggcctgaagagtaggaggaggcagcaggagaggaggttggcctgcttcattcacttgcaagctcctgctgatgctgtcatctcctggagggcttgccagggtcccaggggcctggggttctgggctgagcctcaggctttagcctggaatctgagctccacctctgatgctgctgcagcagtggctggccggctggccagggggctcaaggtggccagctcttacttcctaaatggaagcagattccatttcccccaaaccagcctctgtcagagatctctaggcctggcctttgaggatcttcttcagacaggattccagaaggaagggaaactgtaatgaacaagatttaggacctgagatgggggttgattcctggggagcttagtttcagccctgacaggaggggagaaggcatcgggagtgtgtcaggtggctgcttcaggtcctgcttcttggggctttaggaataagggcaactgagcaactataaggtcaaggagaagactacataaatatagagaagacaaaagtccaaatttgtttccttccctccttcttcctctcaacacacagttctgagtataggtcactctggattacccccgcttcccctctcactgaggggtgtttgctggctgggaggagacagggactcatgccctagaaggataagttgaataatctggagttgttgatcctggaaaagagaaaactgtgggaaagtgtgggaggtgtggtcttcatcctcagaagtctgaaaggctgtcatagggcagaacactgacaaaaaaaatcttagagctgaataaaaatcatcaggtgtaacctggaggggaagggaccatccaaagatgagccagggaggctggctctcaaatgtactgctctttccatccccgtccccctggccaagtaccctccccatctatgagagtatagaaagcagaacaggcacaaggaggggggttccagggaggtgactccagacttttaatagggaaccactttctgacaactagagtggtccaagaagggaaaggtactaagtccccccctccccaccccaaagctaggggtaggcaagaagtcctctggcagggcattaggtgggagtggaatgggatggcgttcagggttcctgccagcctgggaaatggacccagaatgacgatggtccactgggctgtaaaagagctatgtgccatgggcaacttcctcccttctctgggcttccatttcctcattgccctatggttggccttcctccctgaggactgggttcggatcccaccagggtctgcttgcaacagaagtgatcagagcctagaatctcacgtaagcagctggctcctctccctctgctgcccgattttccatgggcttatatgcttttctctgggtcagtgtctgaggatttcatttaaagaggcagaaggcaaggtagacagagtcagcccatggtggggctgtaggtgtgaccagaggtgccaggtttgacaaagtaagtccacaagttggcctgcctggagaggtgatgagcaacctgtccctggaactcttcgagaaaatgctggttgaccacttgggagagcactgttgagggagtcctggtggcctgagaatctgcagtcaaaaggcttgaggatctttctagaccatgccaagcaggtgtctcctgggacaaagccaactggaaaaatacccactgggcctgggctggacccttgatctcagtgctggcagctccaggaggcccccaccccaattcacctgctgaggctgatttaagtcccaagctcagcccaccttatgtctccccaggtgcaggcagggtggaacgtgtgtgtgtacgtgtgtgtgtgtgtgtgtgtgtgtgtgtgtgtgtgtgtgaagacctgaaatgaagaccacatggcaggttgaaccccacccacgcaagcagggcctggctgagtccagaggagcctctctcgcttttgaggggaaggaaggggccagacagccacgggatggggctgtgcaggcctttctctagcacaagcttttctctccttcttcttctgagccctggcctggtggcccaggccctttctgcctggttggactgatcttttcttatctccgccctcatcaacattcctcattctagcttcgccatcctgagctgggacacatacctgaagggcagatcaaaggcccacagctgctgttgtcagctcccattagaccttggctgagaaggggagcccaccctggcaggctgtcccggccccttcaccttgccttccccatcctggctttcagaggtgagctcaccccaatgtggcgcctccagatgtggagggggccctgcccctgccggccccctccccctgcctctctcttctgaggagaagagaatgctttgaatgcctgagtaggaaccagtcctggagcccggacctgggcagacagagaaaaacagctgtctggacagtggaaacgctggtgcctggggaaggccagtccctgtttcagcaaccctgctagaggtttgccaaagaagctgagatgagggctgagatacgatgtgagggcagtgctctcagggtcttgaggagtcctgggctttcttcccagtcctgtcatgtaaagggagcctttgaggccctcgggatccagccctcgtctacatctccaccctctctgatcttcctaacacacatcacgtatttccccacctccatgctcttgtactcgtctccccactggcttagaatgcttttctccacctgacagaatcctgctccacaggaagaagtagggatagcaagctgcatgtttagtagagttcccttttttatagaaaatgtacctaataatcacttactatgttccaggtactatattttttgtctttagattcaccaggtactattctaagtggtttataccttatttaatcttcataacaatagataagcattaaacaatggacatggcattcattcttctatgaatgaggtaccattatcatcatcaccattttacagatgaagaaacagaggcccaaagaggtacagcctcctgctccatgacacacagcttgtaagtggcagagctggagtacacaccaggtggccttgcctcggagtccgtgctctgaaccatcacgctttgctgcctctcatttctagggcaacagcaagaggaaaggcctgcaagcatatgtgcctaactacctaatggggcaggttggggattctttttagaacatagtgtgtttgaaatgttctgcaatatgtatggaactggatgcagaggatgtggtagtcagcatgtgaactctgggatcagggaaatctgggaccaagttccaactttgctactcaccacatgaatgaccaggggtacctcctcttggtcattggtaaaccagggatgatgagaatccctatttttgggattggtatctggattaactaagatattgaatgagcagcacttagctttaattggccaaaaagccttaatttttataatcaaagacaaagactagaagagccctccacatccaacaaggcactggtcaaaacttacctcctctgggaaagcttcccactctctcctcctcctcactctgcctccaaaaagcaaacaacttgcccgttctacccttagtacaccagctggagtttccagtgtctcagcagcagggaacacgatactctgtcttttaatcattgcttgcttccctaggacatagttcagtgccaggcagagaggggtctcaataagctaattcgtcgaacctttggtgagcacatactcttgtttgctgtacgctggggatagatatatagagaagatgctgccctgctcttggtgagcacatagtctggagtgggggtggaggtgggatggggtaagggtggaggtgggagatagtcttgaaattgtggatcataatagaatatgttgacagaggaaagtgagaggaacacatttgctcaatcattaacaaatatttattgagtgcctattatgtaccaggcactattcctagagatttatctctgatcattagcatactgacagttcagactggaagagtaaggagaagcttcctagaggaaatggaatttggcctggtgaacctgggggagaagggtgtgccaacaatggcatggctacggtcaatggtgctaaggaaatgtctgccccctttgtcccctcatgctggctaaggacaccacaactagaatctcagaagcacccccacagactggtgctcaaagacagatgtcccctttggcctgctctcactatgcccctgtgttccaggaagtggaagtaacacatgcagggccaggggtgaggggcgtctggtgcatttatagaactgtgagtcattcagctgatccgatctggagtgggacagtcagggatgaaggccaaggagaggagagtggggagagggtaggctggagaggtaaatagcggccaggctctcttttggctatggagtatggacttgatcttgtgggccaaggagagtcccagaaggtttctgagtgaggtcatcagatgtgtgcttcagaaagttcactgagtgtgtgaagaagatgagctcagtatgggtcctgttgaatttgaggggcctggaggtcattcaagctggggtggggctgaatcagctcaggggagagggctgggtgggaggcctggggtggagattctcagcacacagataggaactgaagctgacagaagatgagctcacgcacggaggctgggtagcacaggaaaaagaaagggaaggactgagccccggggccttccagcattcaaggaataggagaggaagaggagctggcaaaggaaacagagagagtagccagagagttagtagcgaaacccagaaaatgttgagtggtcagtgaatatttgttaagtgaacttgggacaggagcgatcaacatcaggtatcaaaatgaaccccttgccaatgaagatttaaaggcaaaaaatcaagcaaaatccttatgaatgaaacactggtcataatgtagatttctgagccctggccccagagatgtggattccataggtctgggtggggctgggaagtcctcatttctagtgattcagaagcaggggtctgtggtcattactttgagggatgttgccatcttagaggcagaaagtgaaaggcagagggtagggaggatgttctggtggccttcacccaggacagagagaagggctggacaacagcagcattcccccactcaacacacacacacacacacacactctcacacacacatgttcacacacacacatgcacacacacacacacacacacactcacacaccccccagaccttttagaacccaggtgcaggcccagagcccagccaggagtaaactgagcctcagcgtggaaaatatggaaccaagatatccgggaagggaggcgggcgggaaggggaataatgcaaaccatgcagctctgcccgggaaagagcaaggaaaggggggccggggactggtgaacagcaaatgagatatgagcttgcaatgtgatatggtagcccgctgaagtcagcatctctctctcaccctctttctctctctgcctgcatggggccacactgctgtagcacagagtaaaggcagaggaccccctatctgcaggctcagccctgccaggacattacctagaggtgtcctcatcacatcctattcaaaagaggggtatggaaaaacacccgatattgctgcaggggccaaatcagggctgtgagatgagcagcactctagtgtgctatgatacaggcaacccggattccagtcccagacctaccactgataagctgtgtggtctcggataagtcacttaacctctcttggcctctactgctgcatcagtaaacagaggaggcagggttcagaggatattggcccccccaacttctaacatgtaggtgctttatggagtggtggattttcaccagttttatcctgaccccttttgtagggacaaaaagtgggtgggctggcctagcacttactacttactttgtgcttgggactgtggtgggagctttgtatccagtctcttgtttcagcttcacaacagccctgtgaggaaggaattgtgcccattttacagatgaggacattgggactttggagaacaggccattgggtctgaaggttggaggaagaaggggcatggcttcagcccctgtgtatgctttccccggggctatgtatcctggggcttcctagaacccatgttcccagtcccagagaggagcactcccctagcagcttttgtttgactaatgggcccattgctctgagaggcaggcccttgagtttatagcgcccatatttccccatgacagtgggacacgtgcttatcaagtgaggggtggggaggatgggggcacacatggcttgataaggggccgactaggtattttaaatgtcttttttacatgcccaaggtagccggcagccgtggaggggggggcctcagtgtgcagtctaggcactggggtcctctctgccagcctctccttcaccttgatccgtcccagagtcaatctctcctgacagggatcctctgagcaaacctaatgattgccagctgggagtggaggacccagggcagaggccgccaggaccccacctaaccctggctctaattggctcccccacaagctggggatagctgcctgctctgagttaggcctggcttttctcaaaccaggacacttgcctggccagccaggcccagccagcccttctattcccctgacaagctctttcctgagggcttcctgcagagaaggagaccaatggcatggctctggggtccctccccaacacccagacgtgggccttggcccaggattctgggcaatgagcaagactccagggacttgactgcccctttagggagccccctacccaaagccacacctgacagcctgggtgggtatagggatgggatgtggggctgctccaagtcaggttccttttctccctttttctggactccccactcttgtggtccttcctcccttgtctctgcttgtacaaatctccaaggtctgtcaagacccaacttaaggcctgattcctgctgggcccagtggctcacgcctgtaatcccaacactttaggaggccaaggtgggcggatcacgaggtcaggagttcgaggcctggccaatatggtgaaacctcgtctctactaaaaatacaaaaattagccaggcatggtggcaagcacctgtagtcccagctactcaggagactgaggcaggagaatcacttgaacccgggaggcggactttgcagtgagccgagattgcgccactgcactccaacctgggtgacagagcgagactctgtctcaaaaaaaaaaaaaaaaaggcctaattcttacaatctcactggttgaccttgtctaagtcattggcacctctggaaggtctcagtgtcctttctagctgggaaggtgggacatatcatgactgtctgagtctattcccttgaattactccttgggtgtagcttctcttggcaaccagaaagtaagtggattccttgtcacttgcagaaatgaagtcccaattccttggcttggtattcaagtccacttctcttccacaaagtcttgtagtggcctgggacccggcactatttccagaacacatcaggccttttcctacagccacgcttttcctccggcagttcctctgctggagatgcccctctgtttactcccacatccccaggtcttccaccctcccagatccagcccaagtgggaaagttaaggactccttcctttgtttccagggccattgttagttactggataaacctctggtgcctgcagttgaatattagaattagggtctccttgagagcaagaataaatgtttgttgaattgtaaacataaggaatatctctgatctgcttccctcatacaaggattccacctcccttccatccatagagcacagtgaaatttcatttacagataattacctattcaacagaaaagtccaggttgtagaaagtgctaaagatctgagtcagaagatacaggcaatgccactaacccattgtatgcgtgaccttgggcaagtcacttcccctctctgagcctcaatttcttgtctgggtagtacagcgcagtggttaaactcacggattctagagctagaatacctaggaccaagccatacctttgctgtgtactagttctgtgatcctgggcaagtaacttaacttctttgaccttcggtttttccatctctaaaaatggggaaaataatggtacctgttaagtaagttaataaatatagaacactcagaactatagtaagtcctcaataagcgctagctgcctttattattagtgatcatcaactgccaaatggggctcaggttgcctgacacgtgggagaaaagcaggtattaagagaatgaaagggcacagaaagccctctagatgttgtttgtaaactggatcacacagtacaaatgcgagtcatcatgtgataagcacacaaattgggtttcccttgcaatggagtggtttagtgggcaggtgtttgtgtgtgcagattcccaggatgggaaaatacatggaacttcagcagttcacaacgtctaacatacttcctcaatcatttgcttatttgatctccacaacagcccatgcaggaggcaggggagagactgggatcctcatttgtctggtcttaaaagtgaggctcaaaggaaagggaagtgatttgtctaaggccacacaactaaaaatggtcaaggacttgagcccagatcttctgagtccaggcccagagttggaagaactcacccaagaggacagagtcactcttacttctctccctgtttccttcacctatgctgaactccattcctttggtggatacacctcatggcaagccctgtgcagggcaccaaagatgcagagatgaaactacacaagctctgttcttgaggtggtctgagggatgcagaggcgagagcccagaagtgctgttccaaggagctaagagctgctaaggaccacaatggaggcacatacaaagtgtggtaaaagcacagaggagggaaggctagtgtcatgtgggggacaggaggaggtgggggatgggttgagggagagaggatggggcagtggagagatggcattcaaaagagtgggtggagcattttctgagctggtagcaaggtgtttggcctggaaagtgggtggcccagctgcagatggtggattagccccaatgctgtctgccattgatgagctggcattatgccaccagcctcttgctcgggctccttcgtccctgcattggccacagcagtaagtaggacaaagagctcttagcggaactgtatcctcactgtgttttcgcattgaagaggtaaggaggagaggacagaaaccaggaaaaggttaactagcgagagaggggacttcaagcctaggtgagaatgagtcatcttagctcccagagagctggaagccatggtggaatcttcccaggctcatcggtgatccgtgggcatgcagatttgacaagggagaggcttgacctcatcaagttgctggcatgtgttggtcacagagctgggatgtcagagatcctgcagagcaggtaggcatcttggggtgggaggcctgagtcatcaagtcccagcagttgagagcaaatccgctcccaacctggcgttcttaacagtacggaggcccgttctttccacttgacattcattatctcagtgcatcctcacgctaaccctgtgacttaaccccatgttgcacatgaggctcagcgggaaaggacctggcccaggtcacgtagaagtaagtggtggcctgtgtgcttctcactccctgcctgcgcagaggcggcctcccattgtgagccagccagaagcagagcattctgccgctttcgttatcagagaggaagaaactgacaggtactcaagggaccccaagtttatgctggtgctaaattgggagagaaacacctcatgtgggcccttgcctgaggggcactgagcagcccagtggtcaatgtcctgggcaatggcttgacaacccaacagacaccgttaacacatggctgttttcttctcgattttcatcagataatgtttatttctcttcccgattatgaaaggcacacaggcatgcctgtttcttgaaagggcctttgataagagccgagggcagtacatgaaagggctgctccgaaagggccattctgccagcgcttatacgcatgtggccagggtggtttttttggttggtgttttgtttgtttgtttgttttttggtttttttgtttgtttgtttttttaggagatgaggggaacaaccagagcggtgggcgcccaccatggcgcatggacgcttccccccatcccagtgtgcctcacaaagggactcttgttccctctgtcttggggcaggccctaggcactctcacttttagaggcttcaccccacagcgtgtcatatatatgaaaatgctcccacatcccatattaaatgtaatttttgccataaaatatttcaaaggattttataattccgctttcgaaattatttgcctatgagtaactcgtttcattcccaattggctctgatttctttgtaatcactgtgcatacttgggaattcttgcaaagtgaggaaatctaaccaacaaattgttttcaaatgtaatgaaatttttaggaatactaaatttaacaattaatgaggttggtattatattacattttgtagacgtataatagaacatttattaattccaattctgctgttttcttttcatattttagagccaataaattttcttggg

SEQ ID NO: 1076 - DNA, 41323 bp, mus musculus; identical to SEQ ID NO: 1075

SEQ ID NO: 1077 - DNA, 41323 bp, mus musculus; identical to SEQ ID NO: 1075

SEQ ID NO: 1078 - DNA, 41323 bp, mus musculus; identical to SEQ ID NO: 1075

SEQ ID NO: 1079 - DNA, 423 bp, mus musculus
cagtcccgctccctcctcctctccgtgcctctttctccgccctgctccccgccaaacacacttgcacaggggctctcaaggtgttctccgcacagcggaagatggcgacagactgagggtgcatggccagcgggagccacggggccgtgccgctgggctgcagccacagcggtgcgaacgagaggcggaagcgagaggcgcactaagtaaagcccggtgtctgcgtccggcgcctgtggcgctgccgggagccaggtggcccgcccgagccggaactccaggagcagcgggtgcggagccagagcggagcccgccagggactggccccggcgaacacccggagcgcgaacgaagcccgaagggcccggcaacggaccggccggccggcctaggagggcgcgagcgaggcagggagcggcgtgg

SEQ ID NO: 1080 - DNA, 271 bp, mus musculus
cccgcgctccgtcgctctcagcccgggcgccgccgcccggcccgctaggcgctgcccggcgtcccggctgggggcggtgcggggcactggggcggtggcggctgcggcggcggcgccgcactcctcatagtgtcgggcccctcagctgccctcggctccgtgccacttcactccgcgccggcggccgcccggctcgcactccaaaccggccgtctcggttcggcgcagctctgcgcccctcagcgccgccgtgcgggccccgccgccgcgc

SEQ ID NO: 1081 - DNA, 154 bp, mus musculus
tgccccgcaccgcccccagccgggacgccgggcagcgcctagcgggccgggcggcggcgcccgggctgagagcgacggagcgcgggagcggcgcggagacggcaccagagcgccccgcgactccggcctgagcggggcatcgcgccggccggcc

SEQ ID NO: 1082 - DNA, 343572 bp, mus musculus
tgggcgtcccggcagccgcttgagggatggggcggggtcggccgggacctcctccttcattccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaaatgttggccaatactttttggcattcaggatggacagagccatttttatagactgaggattagcagaacagctgtactgtaaggtttctgtgatggcatgaaactcttacaggtgtataatggcatttagttacctaccctttgtgtggcactaaaatagttctgtctagatttaaacacagcttcctatcttctgtcttttattctttctgttttaatatttttgagcaatagaagcaaggatactagctctttacatttgttgacatcaattggaatcagtttcctagagttatgaagggcttatatgagtccatttcgtttgattcccttgggaaacataggccctaaagggaaagtgacttgcccaaggtcacataactagagtcaaaactgggatgatagttgctctaactcctagttgggtgcccattcccccaactacctcctgggaccttttgcgagggagcaagatggagctccacattagaacttttgcaaagtagagggctcagctctgcatcattttgttctactctgcctgtattttgaccacagtaagtttaaccgtgtgttccttattcttcctgaacttcactttcagatttggagtatactttgaaggaattttagcccaaattcaacttgtttattttaagttgttcaacttaagtttatcttatcttgtatattagttttagtatacaaaaataactttttaaaaaagttgattgggtattaaattaatactgctacaagcttggttaaaatttctagtgccctggtgcaccctctgctggctttacagtgacatttaattttcagtatctgctgacactcagaattctacattgtgctgacagattctgattcagtaaataaggaagtaaacagccttgtgggatttggccacgtaggtcatatttttatattttagtttttaaacacaaacaactgctgttacagcaaatcttggatggagaggaagaaagataaaaatatacacccttcaacgggcagtacattcaggtttcttaccagtttatctgtaaggagtgaaggcaagctgatgagagtaaactgcaggaagctctcatgagaccaagtgggcagaacagtcagagacacttcatgcaggtaggcaaaagtaaacctatccatacttatgagatgatgggctctgggctctcagttatgactcaagaaagggacctggaaatcactgtagatgtatgtatatcatctgtcaatttaaaaactttttaagcagggcacacaaggaagttagggcaggtaggatacagagcagagagatcagcacagttctccatgtgaaatgttagaaaagtctccctggtggggacacacttgctgatgatgaagtgagagagtcacatcagaccttccgtaatcaatcatctccttcagctggagcaaccaagtagctgagatttgtctggatagttggtggagattatctcaagagcaagggatatctcatttgtgtctgaattaggacaatatacagtaatatgatcgtcagagtaaaaaactaaaaatcactgttgatcattctgtggagatgttgcgccggttgtgattgtggtcctcaaaggccaagaatgtagtgggtatcatcaggaagggtgtcaaaaacaacaaaacaaaccacttacaaaacacttattttttccatgtacaagatcaaaagcagattggcttctacaatcagacaggaaattctggtggctgctcctcaagaaaagcctaacagctgataaaagtcctcaaaaaccccattaaattgatcaaaaggatgaagggattttctagttggtttttcagtctggatagaaagaggttgaaggaggaatatgatcaaagtctaccaaaccatgagcgagatgaatatgattaatatattggtgtaacgtaacaatccagttcaataaatagaaagcctgctgtgccagacacaatgttaagtattagacaccttttaatgtttgaaaaattattttcaagaggaggcaaataaaggtagtatcttattcaactcattgtctcaagtaatagtcaaaattatgggtagatcaatacagatttacttagaactgttagggctatttggagtatgttcctaattatttgaagtgatgtcatagatgtcaaccttaaagttctacaaaacattgcttgacataactagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatgtgggtaaatataaacaaacattggctttataaaacaataataatgtctaatttgtaagttaaagaaaaactatatagaaagaaaataccagacaataacatgatacaaaccagcaggggatgatccaagttcaggaaaagattgttcatgaatatactaaccttaaaacttaaatatacatgctgtaaattctagggtgaacaataaaatagtagaaatagagtagatagctttcaaagtaataggagtgaaggggatcctcaatccataacagtggggaaaaaggaatatgaaaagaaatatagaaaaagtgggagaaatacaaagcacaaaatgagctggtatgtatataatcacagtagatgtaaatggactaaattctctggttaaaagacaaaaattatcacacttacaaaataaatttaggcatatgctctctataagacactcatctaaagcataagaacacaggaagattaaaacccaaagaataaaagacaaatactaacaaaaaactgagatactacattactatcagacaaaatagaacttaaggcaaaaagaataaagtaggtttctacttaaacatggtaaattaaccacgtttctgtcatttagtaggagtttgtgagatatttgagataaaaatgataagaatccatgaggacaaagagaacaggagaagaaacttcaattcatgagacagtttaatacatattgaagagaataggtagaagatagatgacagcaagtattagttatctacggctgcataacaaattactccaaaacttagtggcttaaaataacagtacttatctcacaccattcctgagagttaggaatctggaagtaatttacttggggattcctggctcaaaatttttcatgaggttgctgttaggaagactacagtcatctgaagatttgactggggctagaggatatgcttccaaaatggctcactcacatggctattcgcaggagtcctcagttctccaccacatgggcctctccacaggttgcttgagtaccattatgacatgttacctggcttcctccagagcaagtgatccaaaagataaatgatgaagacacagtagtaccttttatgatttagtctccaaagttgcataccatcatttctgctttattctgttcattagaagcaaggcattaagtccagctcacattcaagagggaaattaggttttatttattgaaggaaggaatatttttaaaaagttgtgaacatacatattttcttgagacagagtctcactttgtcacccatgctggagtgcagtggcatgatcatggctcactgcagtctcaacctcctgggctcaagtgatcctactgcttcagcctccccagtagctaggactacagtcatgtgccaccatacccagctattttattttatttttttgtagaatcaggatctctctatgttgcccagtctagtcaaacttctggcctgagcaaacccctctcctcggcctcccacagtcctgtgattacaggtatgagccactgtgcctggccaagaacatattttaaaacaaccactgagtggcaactgagtgaagtagagtaactacaacacaaatgcctgcataatgtggtacttactagaaggagccaattggccctgtataacccctgagagatttgtaacttttaagcactgaatccaacaagaagccagggaaatatgcagggctgaaaacaatagccttgactaaaaatccatgtaggaaatagttggactctcagatcccctcactctaacacacaccacaacagcaccaccactaggaaagaaaatagatttttattttctgaaaaaaaaaaaaaatagatgaatatctctatggtaaaattaatagatggtaaaccaggggatactgtcctgccctcaaattggtacccagtgaattgtgtgcctccatcctctctcttgcctctcctgcacagtaaggaaatacaggattcttaagaaattaaatggccagagaaaggacctccagatactgatatttgagactcccctaaacaaataatcaccttgccttcaatgaccctaccatatggtctacccattgacaagctccaatcatgtgcacacaactttcagtcagttttttattgattcattttttaacatgaacatgtaggcaaggattactacatagctgaggaagcctcaaacattaaagatagggtaaacaacagccaaacagaaaagaagaacttgaaaaaaatagacaataaagcaaacagaagaaaagtgtatatatatatatacatatatatgtatatatatgtgtgtgtatatatatatatacatatatgtatatatatgtgtgtatatatgtgtgtgtatatatacatatatgtatatatatgtgtgtatatatgtgtgtatttatgtgtgtgtgtatatatgtatttacacatatacatatgtatgtatatgtatgtatgtgcatctacaggtgtatgtatgtgtgggcatatatgtatatacatacatatgtgtatgtatatgtgtgtgtgtgtatatatattctgtgcaaagtgagagagggaatagttgtgtactagcttaaatattgcaccattttgtattttgagatggttgaaatggaaccaagcactaaaatttgaaacgatcttatacacatgcaaaaactggcagcttttcacatgtagcattatattgacattttacttgacttcctaagccactagtgaattaacctggcttctttgtattcattattttaaagaatgtattcatttgtttttacatactaatgttagaagtaggtgctggggtagagctaacttaattgctctctctctctctcagtgttgttattcttttttaaaatgtttgttttatagaagtataatttacatacagcaaatgttgccttttaaatttttaattttaaaattgtactattctgacacaaccaaggaccctcacagagtccacttcactcccctgctaactccactggagcaggtgctggtactcacagctgcaagaactgaagatggatcacacctgaaaattgatgcactctttgcagacactccctagtaccagcccagagcccattagctccactgggtggctggacccagaagagaaataacagccactacagttcagctctcaggaagccccattcctaggggacagggagaacaccacatcaagggagcacctcgtaggacaaaagaatctgaaccatagcccttgaatcccagatcttccctctgacatagtctacccaaatgagaaggaaccagaaaaacaattctggtaataggacaaaacaatgttctttaacacccccagaagatcataccagctcacaagcagtggatccaaaccaagatgaaatctctgaattgccagaaaaataattcagaaggtcaattattaagctaatcaaggaggcaccagaaaaaagtgaagtccaacttaaatcaaaaacatggccaggcacagtggctcatgcctgtaatcccagcactgtgggaggctgaggcgggtggatcacttgaggtcaggagttcaagaacagcctggccaacatggtgaaatcccacctctactaaaattacaaaaattagccaggcatggtagtgcatgcctgtaataccagctactcgggaggctgaggtatgagaactgcttgaacctgggaggtggaggttgcagtgagtcgagatcgccactgcactccagcctgggtgacagagcgagactccatcttgaaataaaaaacatgatacaggatatgaaagaaaaattattcagtgaaatagatagcataaataaaaaacaatcacaacttctggaaatcaaggacacagagaaatgcaaaatgcactggaaagtctcagcaatagaatcaaacaagcataaaaaagaacttcagagcttgaagacaaggctttcaaattaacccactccatcaaagacaaagaaaaaagaatttaaaaaatgaataaagcctctgtattagtcagggttttcttagacagaactaatagggtatatatataaagtttatacttaataaactcccatatatatacatacatatatatgtatatatagtgggatcacaaggtcccacaataggttatttgcaagctgaggagcaagaagagccagtccgagtcccaaaactgaagaacttggagcccaatgtttgaggacaggaagcatccagcacgagagaaagatgtagactgggaggctacgcctgtctcttcttttcacattttcctgcctgctttatattcactggaagctgattagatcgtgcccaccagattaagggtggatttgccttccccagcccactgactcaattgttaatctcttttggcaacacccacacagacacacccaagattaatcctttgtatccctcaatccaatcaagttgacacttagtattaaccatcacaagtccaccccttgtcaacttgaacccatacacatctcctgagatcattcataatcttcaaataaagacaatgaggtcataattacacctaacataatacaactgtccttcgtacaactggaattgcaccaatccccaactcaaatactattaaataaagttaacacttaaatgctgatacgaagtcagtaagtcttacgtcacatgataaaggaaaaggaaataagatgaagatattttcttagtacaagtatataaatgcaccaacatgtttttaacaaaagaagtaggaaatattcatgacagttacagtccccgtttctgcagctggtcatgtggtcgtagctggtattgatgactaccttcttctactacccattctgtattctctttgccttcagcgagcacctcagcaggtcatggcttttttcctggtggagtgactcaaaccttcattcctggagggtctgggtcattcatagtcctgcctggattgggctgttgtagtttcccattgaccttaatcacaaggtatggtaatgctaagagacgccctaatggatctcctgtattccatgcatactcttccttaccatccttgtggagtagtagacttatttcatgttgatagcctgggtcaaccaccccagccaacactgtaactccccttttaccctgttgacttaagattaggaggagcctaaagtgtccaggtggcaatcttaacttccagtttaatggaatcattgttatgtctcctggtggcagcgttcttccctctagaactaagatctctaggccagcagaacgtaatgttgcgggaacaggaggcaaaaattttgctagtggatcactaggggtgatggtaagtggtgccacttccacttccatctcttgattcctggacctgtgaattctggctatgggagaaatagtaccatatattggatgctgattcagagcatacacggccttatggagaactttgccccagcctggcacagtgttgtcacctaattggcattgtaatcgtgacttcaaaaggccattccaccgttctgtcaatccagctgcttcaggatgatgggaaacatggtaagaccagtgaattccatgagcatgagcctactgcctgccgcacttctttagccataaagtgagtgcctcggttagaggcaatgctgtgtggaatactgtgatggtggataaggcattccgttagtccacggttggtagtcttggcagaagcattgtgtggaggataggtaaacccatatctggagtaagtgcctattccagtgaggacaaacctctgccctttccataatggaagaggtccaatataatcaacctgccaccaggtggctagctgatcaccccaaagaatggtgctatatcgagggctcagtgttggtctctgctgctgttaaattgagcactcagcagtggctgtagccaggtcagccttggtggatggaagtccatgttgctgaacccatgcataacctccatccctgccaccatggccactttgttcatgggcccattgggtgatgacaggggtggctgggaaaagaggctgagtggtgtacacagaatgagtcatcctattcacttgattattaaactcctcctccactgaggtcacctgttggtgagcattcacatgggatacaaatatcttcatagtttttgaccactcagagaggttcattcgcctacctcttccccaaatttctttgtcaccaattttccaatcatgcttcttccaagtccctgaccatccagccaaaccattagctacagcccacaaatcagtgtataatcgcacatctggccatttctccttcatgcaaagtgcacaactagcattgctcgaagttctacccactgggatgatttcccttcaccactgtccttcagggatgtcctagaaaggagctgtagtgctctagcttccactttcaggtggtgcctgcatatcatgcagaaccatctgtgaacaggctgtaatcttctcttcctctgtcaactgatcatagggaactcctcatgaggccattggtgcaggctgggggagagaaggtagggtggcaggagtggagaccatgggcatttgagccacttcctcatgtaacttacttgtgccttcaggagctgcttgagcccaatcacgtatataccacttccatttaatgatggaatgctgctgtgcatgacccactttatggctagatgggtcagaaagcacccagttcatgataggcagttcaggtctcatggtgacttgataacccatagtcaaactggaaaagcccagtctctctggccaagagctgtctctcaaaaggagagtagttatctgcagaagatggcagggccttgctccaaaatcctagaggcctccattgtgattcacctgtgagagcccgccaaaggctccaaacagcatccctaccagccactgacacttcaagcaccattgaatctgctgggtcatatggtccaagtggcagagcagcttgcacagcagcctagacctgttgcagaatcttctcctgttctgaacttcactcaaaactggcagcctttcaggtcacttgataaataggccagtgtaatacactcaaatgaggaatgtgttgcctccaaaatccaaataagaccactaggcattgtgcctctttcatggttgtaggaggggccaaatgcagcaacttatcctttgccttagaaggaatatcttgacaggccccacaccactggacccctagaaattttactgaggtagaaggttcctgagttttagttgaatatatttcccatcctctggcatgcaaatgtctcaccagtaagtccatggtgtttgctacttcttgctcactggttcgaatcagcaaaatgtcatcaatgtaatggaccagtatgatatcttgcagaagagaaaagcgatcagggtctctccaaataagattatgacacaaagccagagaggtaatatactcctgaggtaggatagtaaagtatattgccggccttgccagctgaaggcaaattgcttctggtgggccttatggacaggaatggaaaaaagggcatttgccaagtcaatggctgcataccaggtaccggtagatgtgttaatttgctcgagcaatgaaaccacatctggtacaacagctgcaattggagttaccacttggttaagcttatgataatccactgtcattctgcaagatccatctgtcttctgcacaggccaaatgggagagttgaatggggatgtggtgggaatcaccacccctgtgtctttcaagaccttgatggtggcactaatctctgcaatcccgccactgatgcaatattgtttttgatttactattcgtctaggtagaggcagctctaatggcttccatttggcctttctcaccatagtagccctcaccttactagtcagggagccaatgtgagggttctgccagctgctaagtatgtctatgccaattatgcattctggcactgaggaaatgaccacaggatgagtctggggacccactggacccactgtaagtctgacctgagctaaaactccattgattacctgacctccataagcccctacttgacgttttgggtcccctggaatcaaggtcagctcagagccagtgtccagtagtccccaaaatatctgatcatttccctttccccagtgcacagttaccctggtaaaaggccggaggtctccttggggaaggagaggagaaagattcactgcataaattgtcagtaatatagtggggtccttcctcaaggggacccagcctccccttcattcaaggggttctgggtctgtaaacgggctcaagtctggaaattgattgaggggctgtgattcaaattagttttttgtccatttgacctagaagttttctgtttgtgtaatttaagtaggaatgcagtaggcttcctatcaatttcacttctaggaacaccatgattaattagccaatgtcagagctctccactagtcagactattctgattgttgctttgcctctgctgtccattatggtagccatgcccaccttgcctttcatggttgagtgctgtcacgtggccgctgccacctcaggatccaattattcccattgtatttgaattttgtagttgagtgactatggttcccaccattagatctgacatacagagaagagcaattacagggctattcaaagatgcaggtgctgccctcacaaatctattttgcaaggcatcagtcaagggtatagcttctggaccctcccagctgggatgagtaagtctaaagtaactaatccactccaccatcccaatctccctaagcctttggatcccttcctctacattaaaccaagaaagatcaggcatttccagctcactcatggtgggccatcttttaatccatatttcagctaaccaagcaaataaactattataaccttttttaactccctgagctgcaacattaaaagcagagtccctacttagtgggcccaaatcaataaattcagcctgatccaactctatgtttcttccaccgttatctgatacccttaatatctattcccatgcttgttctccaggtttctgtttatattaattagagaactcaaacagttcttttccagtgtagtgcacctcctcatgggtcacactctcaaacttacctctaggggcccgccgggagtttagtctagttataggtctagaggcaaacagagatgttgggggtggtttctgaggagaatcaacattatcttgcctggcaactgcctcaggggaggccattactgttgcctcaggcagtgcagggtttatctcctcaaaggtggacaagctgatggcagcataggtcagggaggggacgttgccactactagggatggggaaactgttccttcttgcaaaaaaggttcatcagagtttgcaaactcagtgtgcccagcttcatcagggtcctcccacgcatccccattccaggttgcagggtcccattttttttccaatcaatgccctcattttaacagtagatacttggcaaggctgtgcatgcatctttcattgtaggtcaaccactcgtatagtaagagcttgtgtctgtttttccacagtttcagctctttctctgcaggagataagactctcactcagggcaatcttagcagatttgcggctcagtatctgcttctgaagtcaggtgacagaatccctgagttcattttctttcatcactttttccactgaacttaggagcaaccaaccagcttcattatgttccttggttctccacatatggtcaaaggtattatgtatagagtcattgagctccttgcctctcatgagtggtgaatcagaagtgtcaaatgcatttattttgcataactctctaaacagtttctgccaaggactattaatgttctccatactattagaagtagagtccttagcatttttgagtctaatcatattaagcagccaactccagaaaccccaaaaccaacaaaagaactccatgcttaatattctgtttctctagaaacactcctggtactaaaatctgtattagttatggttctttcagagggacagaactaacagtatgcatatataaaggggaatttattgagtattaacttatacaatcccaaggtcccacaataggctgtctgcaaactgaggagtaaggagagccagcctgagtcccaaaacggaagaacttggaacttggagtccagtgttcgagggcaggaagcatccagcatgagaggaagatgtagactaggaggctaggcccgtctctccttttcacatttttctgcctgctttatattcactggaagctgattagattgcccactggattaagggtggatctgccttccccagcatactgactgaaatattaatctcttttggcaacacccacacagacacacccaggattaatactttgtatccctcaatccaaccaagttggcactcagtattaaccatcacatcttccaagaactttgggactatgttaaacatccaaacctaagaataactggctttctgaggaagaagagaaacctaaaagtttggaaaagatatttgaggaaataattgaggaaaacttccctggccttgctagagagctagacatccaaatacaagaagctcaaagaacacctgggaaattcatcacaaaaagatcatcacctaggtacatagtcatcaggttatctaaagtcaagacataggaaggaatcttaggagctgtgagacaaaaacatcaggaaacttataaaggaaaacctatcagattaacagcagatgtctcaacagaaaccctacaaggtagaggggattggggtcctgtttttagcctccttaaacaaaacaattatcaatgaagaattttgtatctagtgaaactaagcttcataaatgaaggaaagatacaatcttttccagacaaacaaatgctgagagaatttgccataaccaagctggcactacaagaactgctaaaaggagctctaaatcttgaaacaaattctcaaaatacaccaaaatagaacctccttaaagcataaatctcacaggacctatataacaataacacaaacaaaaaaacaaagtattcaagcaacaaatagcatgatgtatagaatagtacctcacatctcaatactaactttgaatgtgaatggcctaaatcctccacttaaaagatatagaatggcagaatggataagaattcaccaaccaagtttctactgtcttcaggagactcgcctaacacataaggactcacatgaacttagataaaggggtgggaaaagataatccatgcaaatggacaccaaaagcaagctggagtagctatactaataacagacaaaacaaactttagagcaacagcagtttaaaaagacagagcaacattatattaatgatagaaggactagtccaacaggaaaatatcacaattgtaaatatatatgcacctaacactggagctccaaaatttataaaacaattactactagacctgagaaatgagatacacagcaacataataatagcgagggactttaataccctactgacagcactagacaggtcatcaagacagaaagtcaacaaagaaacaatggacttaaaatatgccctacacaaatagacttaacagatatatacagaacattctacccaacaactgcaaaatatatattctattcctcagcacatggaacattctccaagatagaccatatgataggccaaaaaaaactcaacaaacttaagaaaattgaaattatagcaagtactttctcagaccatagtggaataaaattggaaagcaactccaaaagcaaccctcaaaaccatgcaaatacatggaaattaagtaacctgctcctgagtgatcattgggttaagaacgaaattaaaatggaaatttaaaaattctttgcactaaacaataatagtgacacaacctatcaaaacccctgggatagatcaaaagcagtgctaagaggaaagttcataacattaaatgcctacatcaaaaagtctgaaagaatacaaatagacaatctaaggtcacacctcacagaactggagaaacaagaacaatccaaacccaaatccagcaaaagaaaagaaataacaaagattagagcagaactaaatgaaattgaaacaaacaaaaaaaatacaaaagataaatgaaacaaaaagctggttctttgaaaacataaataaaattgatagaccattagtgagattaatcaagaagagagaagatccaaagaagctcaattagaaatgaaatgggaaatattacaactgataccacagaaatacaaaatatcattcaaggctactatgaacacctttatgtgcataaactagaaaacctagaggagatggataaattctaagagagaattgaaatgataatttaaaaattgccaacaagcaaagaatccgggatcataaagattcacagctgaattctatcagacagtcaaagaagaattggtactaatcctatggaaactattccaaaagatagagaaagagggaatcctctctgaatgattctatgaagccagtatcaccctaatgccaaagccagcaaaggacataacaaaacaagaaaactacagaccaatatccctgatagatgcaaaaatcctcaacaaaatactagcaaaccgaatccaacagaatatcaaaaagataatccatcatgctcaaggtggtttcatacaagggttgcagggatggtttaacatatgtaagtcgctgggcacggtagctcacgcctgtaatcccaacactttgggaggccgaggcaggcggatcacctgaggtcggaagttcaagaccagcctgaccaacatggagaaaccccatctctactaaaaatacaaaaagttagctggacgtggtgacacatgcctgtaatcccagctactcaggaggctgaggcaggagaatcacgtgaacccgggaggcagaggttgtggtgacctgagattgtgccattgcactccagcctgggcaaaaagagcgaaactctgcctcaagaagaaaaaaaaaggaaaagaaaaaaaagtaagtcaattaatgtgatacaccacataaacagaattaaaaacaaaaatcacacgatcatctcaatagatgcagaaaaagcatttgacaaaatccatcatccctttatgtttaaaaccctcagcaaaatcagcatacaagggacataccttaagataataaaggctatctatgacatacccacagccaacattatactgaatggggaaaagttgaaagtgttcttcctgagaactgaaacaagacgaggatgcccactttcaccatttctattcaacatagtactggaagtcctagccagagcaatcagacaagagaaagaaagaaagggcatccagattcgtagagaggatgtcactgtttactgattatatggtcatatacctagaaaaccctaaagactcatccaaaaacctcctagaactggtaaattaattcagcaaagtttcagaatacaaaattaatgtacacaaatcagtaggtctgctatacaccaacagcagccaagctgagaatctaatcaagaactcaacccctttcacaatagctgcaaaaaaataaaatacttaggaatataactaaccaagcaaatgaaagacctctatgaggaaaactacaaaacactgctgaatgaaacaataaatggcacaaacaaatggtaacacattccatgctcatggatgggtagaattaatattacgaaaataaccatactgccaaaagcaatctacaagttcaattctcatcacaataccatcatcattcttcatataactagaaaaaacaatcctaaaattcatatggaagcaaaaaagagcccacacagccaaagcaagatgaagcaaaaagaacaaatctggaggcctcacaatacctgactttgaactatactataaggctatagtcaccaaaacagcatggtgctgatataaaaataggcacatagatcagcagaacagaatagagaacctagaaataaagtcaaacacttagagccaactgatcttcaacaaagcaaacaaaaacataaagtggggaaagaacaccctattcaacaaatgctgctgggataattggcaggccacatgcaggagaatgaaactggatcctcatctctcactttatacaaaaaatcaactcaagatggatcaaggacttagaaatctaagacctgaaactataaaaattctagaagataacatcagaaaaacccttctagacattggcttaggcaaatttacttcatgaccaaaaacctaaaagcaaatgcaacaaaaacaaagataaataagtgggacttaattaactaaagagcttttgcatggcaaaaagaacagtcagcagagtaaacagacaacccacagagaggaagaaaatctttacaaactatgcatctgacaaaggactaatatccagaatctataaagaactcaaacacatcagccccccaaaaaaccaaagaatcccatcaaaacataggctaaggacatgaatagacagttctcaaaagaagatatatataaacagccaacaaacatatgaaaaatgctcaacatcacaaattatcaggaaaatgcaaaccaaaaccacgtgataccaccttactgctacaaaaatggccataatcaaaaaatcaaaaaataagagatattggcatggacatggtgaaaagggaacacttttgcactgctggtgggaatgtaaactagcacaaccgctatgaaatacagtgtggggactccttaaagaactaaaagtagatctaccatttgatccagcaatcccactactatgtatctacccagaggaaaataagtcattaagcaaaaaagatgcctgcacacgcatgtttatagcaacacaatttgcagttccaaaaatatggaaccagcccaaatgcccatcagttaacgagtggataaagaaactgtggcatatatatatatatggtgaggtataaaggattacacattgagtacaatgtacactgctcaggtgatgagtgcacaaaaatcttagaaatcaccattgaagaatttaataataagaataaaatataagaataaaataaaagaataaaataaaaataatacaataaaaaataataaaaaaagaataaaaataagaaatgtttaaaaattatactattctgagagtttgggcaaatacatacagccatgtaaccatcacttcaatcatcatgtaaaaccattgatcatcttcctaattatcccagagatctttttatagtcaacccttacccctgccctcagctcttggtaactacttgtctgtttcctttccctatagttttgccttttctagaacatcctaaaaatgcaaccatggaatatgtaggtttttgcatctggccttttttcatttagcacaatgcatttgaggtttatctgtgctgttgtacattagctttctatgccttttcgttgcttaataagattacattttatggacatgatatagtttatccattcacaggttgaaggacatttagattgtttccagtttttatgattatgaataaaactgttataaacatttatttatggggttttgtataaacataacatcatttctcttttttaaatatataggagtagcactactgggttgtatgaagaatgtgtatttaactttagaagaaaatgccaaactgttttgcaaaatgaccataccactagacccagcagggtggctcctgcctataatcccagcactttgggaggccaaggtgggaggatggcttgaggccaggagtctgagaccagcctgagcccatctctgtgaatatatattttttaaattagccaggcatgatggtacacacctgtagtcccagctacttagaaggctgaggcaggacaacttgagtccaggagttggaggctgcagtgaactatgatcataccactgtattccagcctaggcgacagagaccctgagtaaaaaaaatgaccataccattttgcatacccttgagcaatatatgagagttcctgttaccatctcttcgtactgttcatttttaaaattattatctcagacatcctaataagcatatagcaaaattccattgaaatttagatttctttaatgattaataaagttgaatatcttttataatgtagtaaagtgtcagtttaaacctgttacccattttttcttttttttgtttttttattatgacttttgagagtcctttatattttttgtatagaagttctttataagacatgtgatttgtaaatattttttctcagtctgtgagttgtcttattgctttcttaccagtgtctttcacacagcagaaattttgaagtccaatttatcaagtttgttctattatagattgtgcttttggtgtcatatctaagaaatctctcccaaacccaaggttacagagattttctcttatttttccttctggatattttataggtattacatttatatctttgatttattttgggttaatttttgtatatggtgcaaagcatgagctgaggttcatcttttttgcatatagataacagttgttcaagcaccatttgttgagactattctttccctattgaattactttgacatctttgtcaaaaagcaattgaccatatatgtgtaggtctatttctggatgctctctttgttcccttgatctatgtgttcattctgttgccagtaacacagacttgattctctcctctaactttgttctttttctttttctttttttttgaaaagatacagttttattaaacaaacctggaatcaacagtatattacataaattagacagcagtaaaattttcctagggcatatgtacaaatcacagtgatttccattgtgcaacagacaggattaaaaataggcactcccctccccgaccccccatgagaaggcggggtcacccccgcagggttcccagttctggctcgccaaggggtgcacaaacctgcaaaggcactttgcttgtgtgcgcggcaacaggggccccagaagcacgttggcaacatggtgaggctgcccagtgttcagcgcaaaaaaataattcagctatggcagctgagcagagctcaacagccatctcagaggacaaggactgtggaaaagcttcaaatctcatccgctaaaacacaattgcaatgccatttacatgcagaacagacgtctccaccatggaagatcaaactaagcctgaacagaacttcccaacacatgataatttacagaaaaccatgacagagcatccctgctattaggaaggactgttctgcggggtgcaaggccataaggtttgcaaagcaaacttgattatgaaaaggcttggtgaaaatacagcccctcaccttcaccaagacacacacacacacacacacacacacacacacaccgcaaagaaactatccaaatgcattaagacacctgttcgtgtgcttttcttcttgcttttgttaagtgaatcccatccgtttaagttagactaattagaaggccttcttgcctccgtcggcaacagagaaaaacagtgcatacgactcctccaatgtgtgtaaaatgcatgctaggtagattgaaggaaaaatgagaggaacccgggcaccccacttcaaatctcatgtttgctgactataaaaataaatcatagtaatattattgaacattctactttgttctttttcaaaactgctttggccattctcgttctttgattccgcgccgccccctccccgcccccaaccgctcccgccaagccttcaaggtactgttcagctcttagtggctagtctggaacctgcactgtggactactgcttagttccgttctcgaagtctttcatattgctgtttaggatctgatccttgcatttgcaacttggggatgagcccagggatttataagcaactttatggaattgctttcctgatcttctccctctctacagtctctcagtcctttcctattccttgttgctgttctttttggttcttcagccatagtgatagggctttagttacctgtttctgtcacatactcatcactactttatctgcgtccagggccaagtggctgtaagaaagaaagaaaaaatataatggtgatcaactcaccctcttgagacctcagctcctccaacaggagagaaagttcgccttccctcagttttaggcaactacagcatccctgctaatgctgatgctgccattaatgctgctgcctctataatggaaatgcttataactaggtcatgagagtatggaaaaaggaaccaaaaaaacacacagagtgtttaccccactgtttcctcctcaaaacagaacaagaaatactgctgtttctttaagaggaaaaggaagatggcatacctgggctggagaaaaattttctccacctacccgttgtttctagcagtatggcttcctcttcctctgtgcctgtgtagcctccatccccagctgaacatgggtgcaggttcctccttccctgcctcctgtgaagtttcactataggccacaaactgtgaaaaatctaaagtcaactctccccatgtgttggtattcttactttcttggcaagcaaattctgttctccaaaacagtagtagtaggacaacaagttgttcttagcaaaggaaaaaaatcactttattgttattttagtttttttaaaaaaccaataaagtggcatattgtatctgattatattgggaggtttaccatttttttgttctgagggggatgggaccaaccaagccattcacaacgaacatgggttcagaggagtttctaaatggaaagagattaatctgtagcacccagaagataagccaaactatgtcattttgagtgaacagtcaggttggcaaggcaatgtacttgaattttcattcaccttttcagctaccaaagaatgtttctacccgtctcttgacctaatcatcctgcagtttggaaaatcaaactctccaatacatgagatgagccaacagagccagaccatgaccaggagatagctcatcccagagaaggacatgcttaacaacaacaacaaaaaattcaaaacatctatttcctccactgctggggactttcaactagttaggcatgtgacttcctggtgactcaggggacgaaactagtgatgaaacagccaccaccatattgccagtagtggacaaaaagagaaggaaagtgaatctgccttacaactgccagaagaacctcaggatttggcatcatcgggtcagaaaaggaaaatccatgtgttgtccttctaccccagtagctgaattatagcattttggtctcctggtatacctcacattgggcagaaatagctatattagcatggatcatagttactgggctttacctgttcccattgggccttggttagggaatatcacttcgttggcttcaaacatgcttatctcacatacagattgtaatctttcctttcttttgggaaattttcctgtatgcaaaacatagagtggcagggagatgcaatgtcatgccccttctccacaaggactttggatgttggactttgctttcttgccattacctagtggttaaagccccatcattgaaatttacatagtttctcaattggtatttgggcaactctaacttcccatgtagaaactttaacttccttatccctgtatagaaaaatccttgcctttggcaagggggagtggtggcaaagcctgacgcatcctgacacctcataccccacgaagtgccttgcctccacaagaaaaagcaaagccagtgaccagtttggctgcagggccagcccctttgcaactagctttccgacatttttgttttaatttttttttttaaggatagctcttaaggggttgatcctgagaggttgggcagggggcttccttcctaatgcactgttctcactctccaccaccaccccccaaaaaaaacctcttactagatatttggccttcgtaacaaaggtaaagagccccaggtccctttagcatgcagagtaatggggatccctccagggccattggcacttcaaggtggtcccagactcataggagattctgttgtcatctttcttaaataaatttgaatacctcagaagtgatttggtcaccagttcagtcctcaccaacacatcacaggactccctccttagcccagttgccatagttgcttagctatattcctcagccagatccttggaattgatccctcccactggcccctatccactcaaatccatttgctctgtggtttttgagctgtctccatttcaatgctgcattagtccattttgcgttgctataagagacacctgagactgggtaatttgtaaagaaaagaagtttatttggttcatggttctgccaactgtacagacatggcacccacatctgctcggcttctggcaaggcctcaggaagcttttactcatggtggaaggtgaagggagagtaggtgtgtcacatggcaagaaagggagtaagagagagggggtggtgccaggctctttttaacaatcagatcttgtggtaactaatagagcaagaactcactcattaccacaaggacagcatcaagccactcataagggatccacctccatgacccgaacacctcccactaggccctacctccaacattggggatcacatttgaacatgaggtttggaggggatgaacacccaaactatctcaactgctgtgatgcctgaggatctttttctttgggattgatgcaattgttttttcttaatttagcatctgtttattgaaaaaaaaactagccttaatattataccattaggagttctcctaagccatacagtccttccagcattgcattctgagcagattgaggcaagcaggctaggattccatggagttataaagagtcttcccttggtgaacagagcatgactcatgtctatgcagtctaagcatgtaagggttgatcagttgctatacataccttggtgcttcccagaggtctcactccagactgctctgcaaatgtggatagagtacaccagcacccagtgtgcattcatgattgccttaatgaacattctcttgctatttttggtctgtctaggagtaaacagggtctaagaaggtgcaagtcaggtgactaggttagcctccaattgaagttccattttatgaggtccccagtagaagtgttgattgcctgtttagtcacagtgagctttaagtacatagaaacagcccctgtctattaggcagaaacatcatcctctaaagtaacttccaacttacttcagtggaaatatacactggtggcgcatattcagtgtcaattctcagtgtttgtaactacttttttttttttgagacggagtttcactcttgttgcacaggctggagtgcaatggcgctatctcagcttactgcatcctctgcctcctgggttcaagcgattctcctgcctcagcctcccgagtagctgggattacaggcatgcgccaccatgcccagctaattttgtatttttagtagagacggggtttctccatgttggtcaggctggtctcgaactcccaacctcaggtgatccaccccccaatcccttggcctcccaaagtgctgggattacaggcgtgagccactgcacccggccctgtaactacctttaatgccagaaatataaaatgtgatgctgttaagtcaaagcgattactaaagatcgcaagcttaatttttaatgtaaatatataatctgttccccctcctagtgagcaagcatggcctacatttctcaagtataagtactttcatggcagcctataacatatctcctcaaaggaactcgatctttcttctgatgcatgtctttcaagcccaatgcctactgtgtcccaaccacctcttccattttcatatttcagtttttcattcccagtgagttgacctgacaatgttgttttgagtgtcagagccatgttagggccagagtttctcagatcaggaactcgtagtaccatacagccaaattgcctttgccaggccactgccaccattaccaccattgactcaaggtgggcagatgaattctagaaatccttagggagccaggataactgggtacccaatttggattgaccacgtgggcaacaggaatttgtctctaagattcttgcctttattgactccccggtgctgtgggaaagtcctatctatacgttgatggccagtgactcccaatcttccccatgatgggttggcagaaatctaattgggatttctttggttttgtttccttagacttttttaatgggaggtttattttgtttctgaataagaaaaagaaaagaataccatggcccttatgaaggtttatagagttttgagcagtatttcagccataaataagcaatcttagaagtctttgatcaactaagtagtcttaaaaatatgctttttagggggccaggtgtggtggctcatgcctgtaatcccagcattttgggaggcaaagttgggaggatcacttgagcccgggagtttgagatcagccagggtaacatagcaagacattgtctctacaaaaaataaagaagagaaaaattagccaggcgtggtgggaggattgcttgagcctgagaggtcaaggctggagtgagctatgattgcaccactgcattccaggctgggcaatagagcaagaccctatctcaaaaaaaaaagaatttttttctaactactactgaaagtgactgagtgcaaaagagtaggtttctccattgtattcaaaataatgagtaggtcccaaaatatagatagtagtagttgacatatttcctcaaaaagcagccaggaaactcacttcagtatttgtttgtatatcagcttacaaaagaagaagtgaacctatactccatgtatttctagcttaattaccaagtagattaatggttgcctaggggtagagggaaggtggaaatatagaatgactgctaataggcaaggagtctcttgtaggtgatgaaaatgtcataaaattagattgtggtgatggttgcacaacttagtgaatatactaaaaaccaatgaatgatagactttaaatggatgattatgtaagtgaattatatctcaattttttagaaacgaagtaaaagtggaaatgtttctatctttacagatttgcttattctgaacatttcatataaaaggaatcagaatcatataaactctggtcttttgtaattgccttcttttacttaacataacatttttaaggtttatccaggttgtagtgttattctattttattgttgaataatattttgttgtatggatataccacattttctttatccattcatcagttgatggacatttgaattgtttcccccttttggctattgtgaatagtgctgctatgaacattcatgtacaaatttttgtttgaatacctgtcttcaattctttcatgtatatacctatgagtgggatatctgggttatatagttactctatgtttcacttttcaaggaactgccaaactgtcttccaaagtggctgcaacattttacattcttactagcaatgctggaggattccaatttctccacatcattgtcaacatttgctattatctctcttttctattataaccaccctaatggatataaagtggtatctccttgtggttttttacttgcattttcctagtgattaatgatgttaagcatcttttcacgtgctcattggccatttgtacatcttttctagggaaacatctattcatatcttttgcccaatttttaattagttcagttgtctcttttattgtggtaaaatataaataacataaaatttatcattttaaccatttttaaacacatagttctgtggcattaagtacattcccattgttgtgaaaccattaccactgtcatctccaaaacgttatcatcttcccaaactgaaactctttaactattaaacactaactccccattcttcttcccagcccctggcaaccaccattctacattctgtctctaagaatttgactattctaagtacctcatataaatggaatcttacaatattttttatgaatggcttattttacttagcataatgtcttcaaggttcatccatgttgcagcatgaatcagaattttatttctctttaaggctgaatgggagagtgccatcaacaagatcgtgaaacaggatgctgttcatatttctccacagcaacaataattttgcagccatccacagacaaaattgtctttgtaggagccttggaattcaggtacaagtttgtgaaacccctgcagaacccaagacttaggaaggtcattttgacaagaggtacccacatccagataacatacttactaacctttgtttcaactccagacccggaaacagccccatctacctgtgggctcagctacagccccatctagctttggtcctgctaccaaaaccatctgccaagaggcccaggggaattatgcatactactgcctcaggagagaggcctactaacctcagtatcagatgtggaccttgaaataacactgtaacttatctccagcctttcttagtaattgtacaagatcaatcctgctcacataaggatccagagggagacacacttaggtccctggggcaggattaccaacctcactcccacagcaggtgcctaaatggctctgaatcccatcttcagcctcacccagctttggtctgagagcaatccttcccacacagggacacagagggaggcatgctttgctgtgctctgcaggcaagccagtttacctagttcccatagtagatcatgaaacagacctaaaaagtggcatcagcccccctcagctgtagcttgagagcagtcctgcccatgaagagacctgcagggagaaatgaccatcagtgaccttgcaggcggacctgatgttctcagtcccactgtggatcttgaaatggccccgttatttggctccagtgcctctcaactgtagtctgatagcaggactgcccacccagggacccaccaggagaaatgccaatctgtgaccccagaaaaaggctgaagacttcagtttcagcttgtaggccctaaaacagccctgcaacttggttctagcccttctcagctgcagactacagtagtactgcatgccaaggtacccactcagtgatccaacaagagctttcccagggactcaaagtaagtcacacccatccacatacctagtaacaggcctgccatctgtgggccctgaattgggtgctcatcctggcaccagtcctacaaaccaacatcctagagacagtccagtcacccagggaccagacaggatccacagctgctagagcccctgataatagacctgccaactgtggaccccaattgcagacccagcagcagccacattacccagttcaaaccccatttgactgtgattccagaggcattccatcaacccaagaacctaacagaagaaggccttaacttaccaaaatcagtctgcaaagactgaaagaggaatttccttcaaatacatggacatcaatgcaaagctacacaaataaggaagaatcaagcaaatgtgagccaccaaaggaaacaaataaagttccaattactgacggcaagaaatggagatctacaaattacctgacagaattcaaaatgatcttcttaaagaagctcagtgagattcaaggaaacatagatagacaactaaataaaattaatagcctaggcagcatggggagacctcatctctacaaaaataattaactggacatgttggagtgtgccttatagtaccagctacttgggatgctgaggcaggaggattacttgaacccaggaggtaggctgcagtaagccatgatcgcaccactgcactctagcctgggcaacagagtgagactccatctcaaaaaaataataaaaacaaataaataaaattaagaaaataattcatgatcaaagtgagaagtctaataaataggaatcatttaaaaagaactaaatggcgctaaagaatacaatgatagaactgaagacttcaatagagagcttcaacagcagactccatcatacagaagaattagcacacttgaagagagaaaaggaaaagaaagtttatttaaagaaatactgtctgaaaacttcaaatgttgagaagggatatagaccccccagatttatgaagctcaaaagacctcaaatgaaataactcaaagaagaatactccaaggtacattatattcaaattgtcaaaagtcaaagacaaagcatcaagagataagagattcatcacatataagggaaccctcataaggctaccatgagacttctcaacagaaaatcttgcaagccaggagggagtaggatggtatatacaaagtgctgaaagaaaaggaaactaccaactaggaatattatacctggcaaatctgtcttttggaaatgaaggagaaataaagacatttacaagcaaaagctgagggagttcatcaccactgggcctgtcttacaagaaatactaaaagaagttcttagaattgaaacaaaaggatgctaattaacaacatgaaaacacatgaaagtaaaaaactccatggtaaaggtaaatacatagtcaaattcagaatactttgataatgtaatagtggtatataaatcacctgtctctagtataaaagttatctctagtataaatgttaaaagacaagactgttaaaaataactatagctataacattttgttaaaggatacacaatataaagagatgaattatgacatcaaaaacataaaatgttggggtagacaaaagtgtagagtttttaaaataaccttctgtaaatataagatgttctgtctaagtcttatgatgaccacaaaacaaaacctatagtaaatacacaaaagataaacagaaaggaatcaaagcataccaccatagaaaatcatcatatcacaaaggaagacaaaaagaggaagaaagaaacaaaggacctacaaagcaaccagaaaacaagtaataaaatgacagtgataagtccttacctatcaataattaccttgaatgtatagggattaaagtctccaatcaaaagacagagtgaccgaatggatttaaaaaaaaaaaaaagacctagtgacattctgcccacaagagactcatttaaactttgaggagacatatattgaaagtgaatagatgaaaaaatatattgcatacaaatggaaaccaaaagagagcaggagtagctgtgcttatgtcagacaaaatggactttaagtcaaaagctgtaaaaagagacaaagcaggtaattatataatgaaaaaaggggtcaattcatcaagaggatataaaaattatgaatatataaggctgaataacattccactgaatgtatacatactacattttgtttatccactaaatctgttgatggacccctgggttgctttcacgttttggctattgtaaataatgttgctataaacatggcggtacaaatatctgttcaagttcttgctttccattttttgtggtatatacccagaagtgaagtggaattgttgtattgtggggtagttatatatatatatatatatatatatatatatatatattatgtttttccacagcagctgcaccatttttacatccccaccagcaatagacaagggtttcaatttctccacatttttaccaaaacttgttattttctggtttgttttttactttttatttatttatttacatatttattttttgagacagggtctcattctgtttcccagactgaagtgcagtggtgcaatcatggatcactgcagctttgacctcccgggctcaagcgatcttcccacttcgtcctccatagtagctgggactacaggcacacaccaccacacctggttaattttttaaattttcttgcagatacagggtcttaccatgtagcccaggctggtcttgaactccttggcttaagccatcctcctgccttggccccccaaagtgctgggattacaggtatgagccaccacgcctggccttctggtttgtttttttaacaatagtcttccaattggtgtgaagtggtgtctcattgtagatttgatttgcatttccttactgattagtgaggctgagtatctttccatgtgcttattggctctttgtatatcttctttggagaaacatctactcaaattctttagccaatttttaattgttttttgtcatttgattttttatttatatggattctttatatattatgggtataaatcccctaacaaatatatgactgtaaatattttctctcattctgtaggtttttgtttcactttcttatgctgttctttgaagcacacagattatacctttgatgatgtctactttatctatattttgttggtattgcttgtgcttttggtgtcatatctaaaaattcattttctaatccaaggtcatgagacttcatatctgttttcttctagcagttttatagtattagcttttctagttaggtctctatggtctactttgagctaattttgtgtatggcatgaggtagaggtctaacttctttcttttccacgtggatattcggttgtccaagtaccatatgtataaaaggctatgctttcctcattgacttgccttgacatcctccttctttttattaaattcaaagtgagtacatggtgaatgaactcccattcataattgccacaaaaagaataaaatacctaggaattcagctaacaagggaagtgaagggcctattcaaggaacactacaaaccactgctcaaagaattcagaggtgacacaaactaacggaaaaacattccatgctcatggataggaagaatcaatattatgaaaatggccatactgcccagagcaatttaaagattcaatgccattcacattaaattaccagtgatattcttcacagaattagaaaaaactattttaaaatttatatggaaccaaaaaaaaaaagagcccaaataaccaaggtaatcctaagcaaaaagaacaaagctagagacatcatgctacccaactttactatattactatactacccaactatactatagggctacagtaaccaaaagagcatggtactgatacaagaacagacacatagaccaatggaacagaatagagaactcagaaataagactgcacatctacaaccatctgatctttgagagacctgacaaaaacaagcaatggggaaaggattccctgtttagtaagtggtgctgggagaactggctagccatatgaagaaaattgaaactggaccccttccttacactatatataaacatcaactgaggatgaattaaagacttaaatgtaaaactttaactataaaacccctagaagaaaatctaggcaataccattcaatacaagcaaagatttcatgatgaaaatgccaaagcaattgcaacaaaagcaaaaaatgacacatgggacctaattaaactaaagagcttccgcacagcaaaagaaactatcagcggagtaaacagacagcctacagaatgggagaaaatatttgcaatctatgcatctgacaaatgcctaatatccagcatctgtaaggaacttaaacaaatttacaaaaaaaaaactccattaaaaagtgggcaaaggacatgaacagccacttctcaaaagaagacatatatgtggccaaaaacatatgaacaaaagctcaacatcactgatcattagaggaatacaaatcaaaaccatagtgagataccatctcatgccagtcagaatggctattattaaaacgtcaaaaataacagatgctggcaaggttgtggagaaaaacaaacacttttacactgttggtaggagtgtaaattagctcaaccattatggaaaacagtgtggcgattcctcaaagacctaaggacagaaataccattctgcccagcaatcccattactggggatgtacccaaaccactgtatatattcgttatatatgtgaagcaatataaatcgttctactataaagacacatgcatgcatatgtccattgtagcactattcacaatagcaaagacatggaatcaacctaaatgctcctcaaccatagactggataaagaaaatgtggtacatatacactatggaatactatgcagccataaaaaggaacgagatcatgtcctttgcagggacatggatggagctgggggccgttgtgcttagcaaactaatgcaggaacagaaaaccaagtaccacgtgttctcacttatcagtgggagctaaatgatgagaacacatggacacatggggggaagaatacacactggggcctgtcagagggtggggagtgggaggagagagaggatcagatagaataattagtgatgctgggcttcatacctgggtgatgggatgatctgtgcagcaaaccaccgtggcacacgtttacctatgtaacaaacctgtacatcctgcacatgtacccctgaacttataagttggaaataaaaaaaaaagtgagtgcatgaagttagaaaaggacgcaggagaaaatttttcatgtggtgatctttagaacctaagctttaagtttgttaaaccttcatgtttctcatgagtaaaatatggtaatgagcttagtacgatactgttgattacaaagtattgaggggtacatatcacattttcagaaagtatttaccttcacagtctggagttataaggtatttgtatgcttctttgacaaatacctgcaaatgtaaatatgcagaaggttaattgagtttttgaatgccatttctactgaacaggagagtttcaggtataaatgtctttgctatatgtaaactaatattacatgctctttcagcttctctttttcatacccaataaagcttttagtaaataaaaatgatgcagatagagaaaatgcttcttgaggtgtattttaataggaaaagtttctgacctgtcagtcagtttttaaaattccagagaagtgtctgccatggctttttttttagacacaaactaacaaaaatgtcacacttatgctgtgaccacagctactattgtccccacagagctagggaccaaaaaatcttccagttctaataacatatttgaatgctaggataaaccaattgaaaaatagattagagccacgaagaacattagagatcatgtaatatttagctcacaaatttagtttgtttgacagtgttttaacaattaaaattagtttcccctattttttaaaggaaataatttcaaataaaaggttgaacttttcttgaaaaccagatgctctggcaatcctgggcctgcattctcacatggtaacaatgggctggaactgagaagtgttcttcaggtcatcactcactcttgtccctctgacactaaaatgcttgtttcatttccatgaatcattacacttacagttatgtttcacgtagcagcccatttcatttattaatgttacctgcctggaccctcacatctgattcaattctcaccccactccccctccatattagctttctaatgctgctgtaacaaattactacaaatttagtggcttaaaacaacaaaaatttgtaatctcacactcctggaggctagaagtccaaaatcaaggttttgggaggtttggttccctttgtgggttctgaaggagaatctgttcatgcctctctggtggctgctggcaaaccttgctattctttggcttgtggacccatcactccaacctctgccttaatcttcatatcactttctcatctgtatctgtgtgtctcaaatcctcttctgcctatttcttataaggacacctgtctttggatttggggcccaccctaaatccaggatgatctaacattgagatcattaactaattttatctgtaaaggccctttttccaaacaaggccgcattcacaggttccaagttaggacatgaacttatctttttgagaccactatttaactcactacaactccattttaaagataagaaaactgaatccaagacaggtttagttactcctccaaaatcatacaactagtttgtgatagaattgattcaaaaacattagtcccctaactcccaaatgagtttcctttccactattttatgttgctcttttacttcagatcagttcatgttccacataaaatatggaataaacataaagaataataagtttcctctagctctatcactttgtaattttgtgcattattttagctgatggaaatctttaaaatgtgtgatctctttaacagtttgttattctctattaaaatatcagaaattagtacataaaccagttgcatgttaatttaaagctgtctgaagaaaagattttgttgttgttcaaattctggctctgttactaaattgctgtgttttcctgggcaagtcccatcctctctctggatttcaatttgcccacttgtaaaacaaaggagttggaccaagatgaattctaaggtctcccccagcaccaactttctgggattctgtttttgcagaattattctgaatgtggttaatcagccactttgaggtactattgtccagctaagcttttaggaatagtagtttccagaagagaaaatctatttcaccaccacctctattttgagttgatttttgtatatggtataagaaaggggtccagtttcaatctactgcatatggctaggcagttatcccagcaccatttattgaatagggagtctttcccccattgcttttgtcgactttgttgaagatcagatggttgtaggggacggctttatttctgggctatttctgttccgttggactgtgcatctatttttttaccagtaccagtaccaatatttttggttactggagacttgcagtatagtttgaagtcaggtaaggtgatgcctctagctttgttctttttgcttaggattgtgttggctattcgagctcctttttggttccaaacgaatatttaaattattttttctaattctgtgaagaatatcattggtagtttgataggaatagcatcaaatctgcaaattactttgagcagtacggccattttaacaatattgattcttcctatccatgagcatggaatgtttttccatttgtttatgtcatctctgatttctttgagcagtgttttgtaattctcattgtagagatctttcacctccttggttagctgtattcctaggtaatttatcttttttgtggctattgtgagtgggattgcattcttgattttgttctcagcttggatgctgttgatatataggaatgctaccgatttttgtaccttgatgttgtatcctgaaactttgccaaagttgtttatcagcttaaggagcttttaggcagagactatggggttttctaggtataaaatcatattgtctgcaaacagagatagtttgacttcctctcttcctatttggatgtcttttatttctttctcttgcctgattgttttggccaggacttccagtgctatgttgaataggagtggagagagagagggcatccttgtcttgttctggttttcaaggtggggtgcttccagcttttgcccaatcagtatgatgtggctatgggtttgtcatacatgactttttattattttgaagtatgttccttcaatgccacatttgcggggtgggattaacatgaaggctgttgaattttatcaaaggccttttctgcatctattgagatgatcatgtgtttttgcttttagttctgtttatgtgatgaatcgcatttattgatttgcatatgttgaatcaaacttgcatcgaaggaataaagcctacttgatcacaccacctctattacgatgaggggatgagggtactttaagtttagtttccagcggtgagactggatttgtacgatgccatccatcttcctcctcaccccatcccttctttgcagcctttctcaacctacacacacacacacacacacacacacacacacacactgatgcacatacccttatcatctttctgtcccagtatatagccattgaaaaagaagtcaactggcagaccaagatgtcaaaccctgattttaaacactttaacaccatcctgaaaccaaaaaatacccgttttgactataaacaggtaaaagagtaaaaataaaaaatcctacattatataaatgttgttctgacaaactgttttcaccctgatttctcttcattgtgctctaatttttaaaccttcttgacatttgactttataggctacaactttccactttccacatttgactttataggctacaactttccactttccactttccacagcggtaattatcatttgttctgtggctagttctgaaaaaggagccaggaaatttgagcttccagcaaaatctccctgagtataattcactagataaactgtacaagtctattctcttttaaataaattacttgagttcttacttaaatgatgtactgtattagtttgccagggctaccttaagaaaataccacaaactgtgtggcttaaacaacagagatttattttcttgcagctctaaaagctggaagtctgagatcagacttccagtcaggtatcagcaggattgatttcttctgaggtctctctccttggcttgcagatggccactgtcttgctgcctctttacatggtctttccactgcctctttacatggtctttccactgcctctttacatggtctttcctctgtgagcacgcatttctgatatctctctgtagattctaatctctcttctgataaggacaccactcagattggatttaggcccactcagcctcatgttaacttaattacctctttaaatatcttatctccaaatatagccacattgtgaggtactggggggactggtgtgacatcttggtctgccagttggcttctttttcaatggctgtatactgggatagaaagatgataagggtatgtgcatcagtgtgtgtgtgtgtgtgtgtgtgtgtgtgtgtaggttgagaaaggctgcaaagaagggatggggtgaggaggaagatggatggtttcgtacaacatacaaatttggggagaagaggacacaattcagcccataacatgtaccatattatttcacacattatgaaatgttaaacctagaagtaatttagagactatttagtataatcctctcattttgtaggttataaagactgaggtacagggaagttaaaaacacttacctaaggcaagccatatggaattagtggcagaggcaggactagaaatcaggtcttccagctccaagttccatgccctttccaccataccatgctgctactttagtccatttgacttattcatgcctttaacttctcttcttctcactcttcctcttgatgatttagaataaatttggcaaatatattaaattagctatttttaaaactatatttaccttaattttcctgtacttactaccctccacaactcaaattttgaaaataaaaatatttaaggagttttctacttaatttcctatcacttttctctttatacatatatttttcactcttgctttgaaataacaggatttttctaaggtaaatgaacttttgcttgccagaatagacaatgaattgaaatcaaagaaccctcagctttttgtcacctttttgggatctgaggtagagaaaaaaatttgcacaaacctatgcctctcccctttcttattacctgtccttctctttccctacagtaggattttaaagcttctagaaactttgatatacacactcctcctccctcccccaccaaaacaataaataccatcattgaactggtgccataaaaagtgcctgatttttcattctttagccagaggtatttaagctcaaactttggaacctgaaaggaaagaaaattctgaatataaatgtacctttcctttacttgtaaatcttctccattcgccttttagagtgaaatatcaagagagaaaagggagaaactttgagttataaagtgagtgatatgaatgtttaagacatttattaaaattaggtgtactcttccatttaatccagggttttacttttacttaaactactaaagaaactatttcttttcaatagtcagctagttacttcagtggaccagggaacacttttttctctcctgtctaaagctccagttgtttgcttcttgagagatagatgtttaatgacaaaaagcctttcttcaaatgagtcccttgggtaacatagcccccatgctgcccctctcttaccttgctgattactaaggaattcatctggataagtcaccctctatggagacaagaaaggggcagggattcatcccatcctgcctctagtgcaacgtgtcagagcttgatcctattgcctgcttattcagtacagacagaaacactgggaagcactaaaatatagatgtctgtgccattaaggtacaaaagactattaaaatatgtctgtcaagcagatctgtattgtatcacagtcttaatgattttgactgtccagaagatagaaatatagattaaatttgattgacatgctctcagactggacatgaatgtgtgggtgaaagtaagtacaggatcatattatttaataaacaatttggacaacatgaaataataaaaacagtgatttctttttcaaatggcattctcagagggtctagaaatttctgatttggtggaggggggttggctataggactcgattcctccccctacccaagtaatttcgactggaagttccatatgtatttttattgtggtaaaaatgcataaagttccactttttatgctttaagattttaatttctgttttctagttcatttgaggttgggcatggtggctcacgcctgtaatcccaacactttgggaggccgaagcaggtggctcatttgaggtcaggagtttgagaccagccctggctaacatggtgaaaccccatccctgctaaaaatacaaaaaaaaaaaaattagctgggtgtggtggcaggcacatgttgtcccagctactcaggaggctgagacacgagaatcgcttgaaacccgggaggcggaggttgcagtgagccgagatcacaccactgcactccagcctgggtgacagagcgagactccgtctaaatagaaaaatcaataattcatttgaatagaaagttcattggtttctaaaaaatgtcctaaagtactatgagagaaaattttttcctgatatctgaatatgtttatataaaaaatcttggctatataaaataaaaataagtgttatgtattgaaattttttattgaaaaccatacaattggaactgccctggttgttgtaccttttgaacaaatttccttcacatagtgacaaattgcttttgtcatcttttccctatccttgttttcagcagtcagaatagcaaggtccactatgttgtctgatgtgcctacagccaggctctgatggagacagagttctcttgcttttttacttctttgcaattaccatggctttcagcagacatttgcacccctgtaacttggtgggtgctgcttttgctatgatttttaagtgtcatcttctatgaagtatagtactgaagaggagttattgtatagtgggaataaaactgttgagctccactggatggttcttttaatgtgagatcataccatccagtaagactcagagggatatattgaaatcacacatttgagaatcacttccattcttctccagcactattgcttatcataaggattgaactagttccgtgagagacacaatgaggtacatctggtgggctagatttgctgtaatagcctcatcaaatggtccatgttaatcacagcaactagcaattgctttaccattgttcaggttgtcatttgcaatctgattatttggtaatgaactgcccttagccgacctgccaacctcaggtctgtttacgaaacctgtgacattatgagaaatacagtattcctagtagtataatccaaaaatctagaaaaccatgttgcaaatgggagggaggtcataattcctgtctgagtattggaagttgcaattattaacagttgtgtgtgtgtgtgtgtgtttgtgtgcgtgtgtcactagataatatgtatatacatatactgtaattattacaatatatatacagtgaatacatatatgtaatttcttaactgttcctacccactctattcattaattccatacaattatatatcactttacattctccaaaatacttccgtatacattcttgtttaatccttatactagctctgttagtaaaaattgttctctattttataaagaaagtgaagctatgaaaggtaatatatcttgcaagatttcagagctaggaaatggttgagtccgaattgtttttctaaactcctagcctactgcttttttctgttacaccccagctatctttgttatagaggcagtgtgttataatggacccagactgcccggatttgaatcagagatcttttacttcctagtggtatgaccttagacaaattattaaacctctctgtgccaaagtttcctcatctgaaaaatggggttaataatagtatctacctttgttgtgaggattaaacgagttgatatagagatggtgtttggaacagtgacttgagtagttagcattatgttagtgtttgatgctattattacctttattattatcattcttgtcataatcagcatattgcatagcatggtggctaagatctctattttttaagatctcagtcactgcatgcaaacagtctagattcaaatccaaactctactactgtgtgaccttggacaaattactttgactttctgtgcctcagttttatcataaatatatatatcatatgtatgatatatatatatcaaacattgggctaagtatgttatatgaattaatttagtagtcataacagccatgtgtgactaacactttatatatttatgatatatatattttaatacatattttatcataaaaatatatatcataaatatataaagtgttagtcacacatggctgttatgactaccaaattagttaattcatgtaacacacttagcccagtgtttgatgttagaacccccacttgccttattcctaacatcttggctgcaaactcagacccatgaggtgtctgtatggcagttgtatattgtatatgacatatgtaattcatcagtcctctatagtctaatcacacaagctagtggtttggttgtcatgatagttcttggtaggaatgtgtttgtcatataaaagttattttggtatggtgtggtgaaatgagtattcactggagatctggttctattgccgagtggccttacaagtgaaattctggagcctggagaaaaaaactttagcaagagtaagaaatgaattctcagtcaccctcttttctctctccctactaatgctgtaatgctatattttccagcctatggtggggtgggtctatagtggtaagacagtgtggtatcattatatttaggaagaaaattgtttcaagtttgaaattttttccaatattatattagaagtcaactggagaatgatatttacttagtagttattttagaaataacttttctaggcccaatctattaagaaatgaaggagatcatcctacagacagatcacaggcaaaccctcattttagggaatgactttattccagaagataatttctaagttgatagtttggcacttgaatatttttctatagaaattatgttatttttctgtagcaattaggttattgtgttattatgctgaagtttccaggttagcctacaacctgtgaaaggattgaaatactgtgatagaactgaaataccgtactgtactgaaatactgttaactagcaattaaagcaaaatgtaattgaataagaaatagcaccttgacactaaagcatgagcatagcagagttaattacaggttaagaagatagatggaggctttgggagagtctttctgaagagcacttctaggtactttcaatggacattagaagttgatggcacaggttttatgtctaacttcagaaaggatgacttttcttttccttgatacagctatctcacagtgctcttataactatcagccattattagggctatttggggttcataaatagaacaaagagaccaagaaaggtaattttgaggtaactgggcaagaaatagcagaagaaagaacatttaaaggggtaatatggatccatgtgaggttatgtgattgcttaaggtggaattgaccacagtaaatgataaaaagaagaaaagtggggagctcagtttgtgcgtaggatcccagtggaaagaaagacagtgagaagctttccaggaaaccccagcacctttttaacttcaattcacacattctttctgtactgttccttttgtgttccctttctcccctactagactagttcttgaagggcagatatggtttcttattcatccctctgcttccaacaataactagcacatagtaggtgttaacacactgtatgttgaaatgatatcacatatgatcttttaggccaattaatgtgcttcttatttgaccagggcattagaaagctgtaaaattgtgctctcaactagcatttggtacatagttctagcatttgagttgaattcagaattgtaatgttataaatagagaactgagaacccatgcatgaattgtccgtttggtatagacctagtctcttttccccatttcatgagtgacatcatcttttctttctccatctctctgtcttggagcatggtctggccaaactaattttgtaaataccctaaagatggagctttggacactccctgattgacaaagctctctggagcttttataccttctctcagaaacacatagtaacattctggttccaaagagatggtgtagagtttgactattgattctttgtcctgcttgcttgcttttgttctgtttgaccccttccctgatgcattcctgctggagacaaacccacatgctgaaccatggggaacagtctgtaatgaaacaacaagctgctcccaattttaaatattgcatgttggggcaaaggcagagttccttttcctctaaagctataacattaaaaaaattctgtttgatattcagagttatttgatctggcagtttaacaactgttgatgttttaattgcttctttaaaggatttcatctacatttctaggtttatttttattttactctgaaggaatgtcaatattagccatcattttgcccagtaagttcccattgcaggatcttggagtaaaatccagtaattactggagctggtaacttaagaccctgctgagaaatttggcagcttcacttttcctgaggaggcatctctccccatggagctagcaatcatttattgttctgaatcaattttaagtgagttttgtaccttagagaccagctttctatgttcctttgaaagctatttaaatcattctttttgggtgaaagaggaatgttaagtcatgttaagtcactctttttttgtatgcacctaataagagcaacaaagtaactcttagacaaatgtacaattgtaagatgtgctagcaagaaaaatttagcaagtttataatccctcagggtcttacttcatttttatttgtctattcataagtttatttccaagaccaaatagaatgttttgttggcgtgctacttacatgtatgcagctagccatttgaattctctcaacaaaactacacacattcaaagcagtttagagatgaaagggtcctctgagatcatctagtctagcctcttctaaatgctttaaccttgtatttattaataaaaggagagctggatgagcttgcatctttgctcttctgtcatatatcctttgaattattccaatgaaaaaaatgtttgttaaatgcttagatgctgaacccagtctgaagcaatttgcttcagaaggcatggttcttagagttttggagcctacacagtaaaaccaatagcactgacatattatatattgtctgtcacattttctcttctgaagtttctttacactccatcatcacccctaccaggccccctccgcacacacacacacataaacacacacacacacacacacacatatcttggggagatgaaaacaaatctcttaaacttttatttttctgctttgaagccacactcccagaaaagacttttttttaaaaaaagtattttaaaaattattaaatttttaaaaattttttttgaaaatttaaattaaaaaactatattatgggtacataatagttgtacatatgtatggggtacatgtgatattttggtttttgttttgttttgagacggactgttgcccaggctggagtgcagtggcgtgatctcaggtcactgcaacctttgcctcccgggttaaagtgattctcctgcctcagtctcccgagtagctgggattacaggcgcccaccaccatgcctggctaatttttttgtattttttttaaagacggggtttcccatgttgggcaggctggtgtcgaactcctgacctcaagtgatccgcccctctaggcctccaaaagtgtgagattacaggcgtgaaccaccacccccagccacatgtggtattttgatacaggcacacaatgtgtaatgatcaaatcagggtaattggaatatcagtcatctcaagcatttatcttttttgtgttaggaatattccaaatcaattcttctagttattttgaaatatacaagaattattgttaactataattgacctattgtactaccaaacactagatattattccttttattcaactgtatttttgtacccattaaccattccctcttcccctcttttttttttctttgagacactatcttgctctgttgtctagactagagtgcagtggcacattcatggctcactgcagccttgaactcttgggctcaagcaatcctcctacctcagcctcccaagtagctgggattacaggcatgcaccataatgcctggccatttctttaaatctctgtagagatagggtctcactatttgcccaggctggtctcaaactcctggacttaagtgatcttcccacttcggccttccgaagtgttgggattacaggcatgagccatcgtgcctggccccctcttctactctttatccaccctccccactagccttcccagcctctggtaaccagatcattttactctatcaccatgagttcaatttttttttgtagcttccacatgtgagtgagaatgtgcaatgtttgtctttctgtgcctgacttatttcatttaacatggtgatctccagttccatccatgttgttgcaaatgacaggatctcattcttttttatagctgaataggactcctttttgttataagtaccacatcttctttatccatttgtctgttgatgaacagttaggttgcttccaaatcttggctattgtgaatagtgctgcaataaacatgggagagcagatatttcttcaatatactgatttcatttcttttacacatatacccaacagtgagattgctggatcatatggtagttctatttttagttttttgaagaacctctatactgttcttcatagtggctgtactaacttacattcccacagcagtgtacaagaattgccctttctcttttacccttgtcagggataatcaaaggttaaatgaaaggaccagccaactgattgatgggagggacactggttaggatagttgaggagaagtggacttagccacaaggtgtattattcagctttcccatatttttccttcctttactctatctcctcaacactgggaatataagacttttcactcatagacttaatgtccaacaaactttttgggaaatggaagcaattactagttcagctgtctggttcttcctctgaatttttttttttaatgccgaaaacccagaaacttccaaatgaatctcctggccttttctactggttatttcttgtgcagcttcactaggcttaaaaggtcagcctcttcattgggccatgatgttatgattgtaactctagactattttcttcttggcatcccttctcaatagatagcactcagtgattgaaagtgtaacagattgctactgtgtgaggaatttcagaatataaactatggtagttagaaaatgatatggatatagtatatgttagaacccgtctttgcctggatcacttttcatgagtctttttctgttgatgttgacccgttctagcccctccgaacctaaggtttttgtttttgttttcacttgacttaactagaccataagctccatgagggaggagactatcctgtttgccttattcactgctataaatttccatatctcatatgcctaatataatacttggcacatagtaggcatccaataaatatttactgactgaattaaatagtcagtagtcttgtcctagttcccgtatttgctacagtaagagccctcttgctgaactctgcctggttattgatgaaaccaggtcatctatgtcttctgtttatctttgagtatagactataccccagcaacttccaacaaccttctggcagcaatatttttctgattgcccactcttaaaactcttcaagtgccctcttctcacaccagatttctgtcctaactaaccatcctacgtcatttctgacaaaatctttcctttatctattgttcaagattatatgagttcaaaaatttcttacgatgtactgtacttgcagtcagtctcctacttgatgtcctatagaacacaaagttacatttgcataataagggccacctcctttctatctcccagaagggctaccccaaatcataaatagtaagaggaatcttttgagcacaaggacaaaaagaagcaggataactccattttttgaaaagaaaattttaaaatatcacattgagatgatggtgtgaaagtactttcctgaagttaaatttgcaagtgtctgccttcttctctcctctgggtatcacactgacacatctgccattcgaattggattttgtgaagcttttgaattgtgagtgacacagaatgctgtggctttcagaatgtctttgtattgttccctcctgagagctaggatgatgggatatattatggtggtgctgtctgtattctcaatcatcagcgcaaattgacagcagcaccataaagtcaggtttattggcacgcgtgcacgcacacacacatacacgcacgcacacacacacacacccctacaggttgttagagtacaagttctacagtatttatgtaaaagaaaaaagaatacttttagctaaacgtaatgtcttttcttctctgtatttccatgcatacctgagaacataaaagatattcaataagtatgtggaaaagttaaaattgttgccttgatgacagtttcatttctcaggctgtagaataattcaagcaaggaattgctactctggtcataattctgaaaaggaagaaagaactgcttggtgagatagtgatgataggcaccttgggagaaagtgagtgtgtcatactagagtttgtaataatgaaggaagtaagtgctgctgatggttccacatctattataggctttacaaaagcatatttcagaaattagggaaatgaaagataggtatgtcccccttgtcttgatatactacatttttttaaatgataagaggctttcaaagttgaatactcctaatttcttggcaatagagaaggaaagggagtatctaaaacagtcatattcaacatttcctgtgccctaacacacaccagaaaggacatgacatatgcctagtaatagtgctcactacagaaggtacaataacacacatcacaatttatagagaagcatatgtattttgaatccccacccaaagggccattctcctctccctagcctctacacatggtgtcattgttttgtgtgactgcacaggaagttatttgataagttcagatgtgacatgttaaaaggaagaacatagaaccaagtacacattctagacaaggacattattctataaatagtatcaggaaagtcagagccttgtaaaaaaaaatgttaaggaccactaaatgtgtacatatatttagttctgtttagagcaagaacaaggaagagctaggcctacttggcatcctgttaaaagtgacagctggcagaactattcaaccagacttctgtattaatgatattgatgttcaaacagaaaagggtgaatggaacatggttaagaaggaatttttgaagctcaagttagatgagaaattagaaaagagatatctattccctttgagtctctaatcccagaagaactagatctaagagaaaagaaaaaaaaatctagagaagaaaaactagatctatgagaaagaagctgcagagatagtcacaaaactactactcccagtttttgagatgtcataaagggtaaattccaaaagataaaagatggacaaattccctgattttctcagagaggaaggttgggagtgatttgctgaagctatggatctgtacacttgacaattactcccagcataattctaaaatgtattttcaatgagatgctttatagacattcattaaagaaaataatggccactgggacctccaagttggttctctaagaagtcattaagaaaataatatttatgtgtcatttcttgataggatcactaaactagactttaagggcaagacatcataaaatagggatccagtaagataattaatcctatatcttgtgttatccttgtagagaccaggacataagagaagactgatagcagttggaggaatttaccttggttgaactctgtgtattcatttcaatgtagagggaattactgagtagcttaccatagagctctgtcctgttcaacactttcatcaataacttggacaaagatataaaaagtatatatatatatatataattattggattatacaaaattagaaacaacagataacatatgcatgacaaatggcttgtctggtatcaaccaaggcaaggtaccatacttcaggaatcactggaaaatattgcatctggaggaaggttttacttaggggctgaaaaccatatctgatgaagaatggggattttttagctttgcaaataaaagactttagtgggacatggtagtggtctttaaatattagaaaaaatggtatatgtaggagaaattagaatgatgagggaatagttggaactgagtggaggatatataggaaggaagattttggcttagtttaggacaattttctaacatttttttctgtttaacatagtagtggtctgtttaataagttagtgagctccttccctatcaatagaggaattcaagcagaagctagacaaccatcttttggagtgattgttaatgtgattctttccttagaggaagatttagacaagatgagttctgaaatctcttccaactctgagattttatgattactatctctactggcagtttttcttgttaacaactgtgtccatcataattttcaaagggaaagtcagtaatcctgaaaattacatcacagatatcctgtttataaaacttttccccccaaatgtttattttccatcttctcatatcttccttcctttctttccttcccattacccatttaaaggcatattcaattagtaatacacctgtagtgataatcagagccctacttatttataccttctacaattatttgggtttttttgtttgttggttggtttgttttgttttgttttgtttgagacagtgtctcactctgttgcccaggctagagtgtaggagcttgatctcatctcagctcacagcaacctctgcttccaggttcaagggattctcgtgtctcagcctcccaagtagctgggattacaggtgtgtaccaccacgcccagcatttttgtgtttttagtagagacagggtttcaccatgttagacaggctggtgtggaactcctgagctcaagtgatccgttcaccttggcctcccaaagtgttgggattacaggcgtgagccaccgcgcccggcccttctacaattatttgtaccatcagaatgagctataaatttgcttgctcttttcttttgtatgtatgtgtttggagaaaaaaactttacaacatttttaacagaataagtcaatatttattttgaaaaagtgatatactgcttagtctccaccatccacccagtaaaacaatctgtcttctagaagtatcaagtactgttttatcatttaggatgtcacctgaaaagattaaggatagtccaagcattctagtatcccctattaaatgactatggatttatctcttgtctataaatgtatacaatttttcttgaaccttttttacccatttctattttcagcctaaatcatttctaagtataatgatgataatgaactcataaatttttgataaagtagtatgcattttcttccacacaagtgtttggcattgttgcatatctcttttaagtggataattcaacagttattaagcccctactatgtgttaggcagttttatatctattattaaagtgcttatgaagtagatggaattactcatagatttgggtttttttaattaattatttttttttttagaaacaaggtcttgctacgttgcccaggctggcctcaaactcctggattcaagtaatccttctgcctcagcctcctgagtatctggggctataggcacactccattgcacccacctactaataggttttaactttggttttcagtgggttatctataatatgctaggtaaaggagagagagagagagagagagagtgtgtgtgtgtgtgtgtgtgtgtgtgtgtgtgtgtgtgtgtgtgtgtgtttcagtcttcctaggggtttactgtacttcttgaatctttaatctatacatttatatctttgaccaaatttggggaaattttgaccatttcttcaaatatttttctaccccattttctctctcctctccttctaagatttcaattacatatgtgtttgaaccttagctttcatcttacaggtccctgaggctctgcttattttttccaatctttttccttcctattgtctaagttggacttttctgtgaatctatcacgttcactgactattttgtcatttccattctgctaagtctgagggtgaacttttatctcaaatattggatttttctgtttcaattttttctttctttttcagttactatttctttgttgagattttctgtcttttactttatgcagatatgttttcctttatacgctgaagcataattaacaatagctgccttaaaatcttgtctgctgatttcaatgtatgtatcacttcagagttggtctctgttagaatgagtaacattttctagtttttttcatatgttgaatgtgaaaaaacatattgtatactggatactatgaaagattgtatactacatactttgtattatatactgggtactataaaagattgtgttatagaccctctggattctgttacattcctcaaaagagtatttttttaagcaagcatttaacttggctgaactcaaattataaaccctctctcccctgcagtgggaagtagctcaaatctatgttcagaacttttatgtttagctgggctgcttgtagtctgccctgcacatgtacagttcaagtgttagccagcgattcagacagaatctatatccagaatttaggatcacctctggctttctgctttctaggatttctccctcactttccaatagctgtagatgcccactctgtcctccagttctttaaaccagtgggaatgcagatttctatctgagttctacacactccatgagatgctaaaagccatttttagaaacagaaaactcactcaatttcccttattttaaatgtcaactcccctctcatgtgttccatctgtatgcttgttttattctccagtgctttcaggtagctttttactttttcttttatccagagttacaggcacacctcagagatatattgtgggtttgtttccaagcaaccagaataaaactaatatcataataaaatgagtcatatgaatttgggggttgcccagtaagtataaaagttatgtttacatgatactatagtctgttaagtgtgcaatagcaatatgtccaaaaaaacaaactacataccttaactcaaaaatagtttgttgctaaaaaatgctaccaatcagctgagccttcagtcataatctttttgctggtgaagagtcgtgccttgatgttgatggcagctgactgctcggggcagtggttgctgaaggttgaggtggctgtggcactttcttaaaataagacaacaataaagttcgctgcatcaattgactattgttttcacaaaagatttcactgtaacgtgatgctgtttgatagcattttaactatagtagaacttctttcaaaattgtgttaaatcctctcattgtcattccaacagtgttcacagcatcttcaccaggattagatcctatctcaagaaacaacttcctttgctaatccataagaagcaacttcttatgtgttcaagttttatcatgagattgcagcaattcagtcacatctttgggcttcagttataattctagatctcttgctgtttccaccacatttgcagttacttcctccactgaagtcttgaacccctcaaagtcatcaatgagggttagacgcaacttcttctaaccttgtattaatgttgatattttgacctgcttccatgagtcatgaatatgcttaatggatctagaatggtgaatcctttctggaaggttctttacttactctgccccaatacatcagaggaattaccatctatggcagctgtggccttatgaaatgtatttcttgaataataagacatgaaggttgaaattactccttgatccacaggctgcagaatgggtgttgtgttagtagacatgaaaacatttatctcctagtacatctccatcagagctcttgggtgaccaggcatattgtccatgagcagtagtattttgaatggaatcttttatttttctgagcagtaggtctcaatactggacttaaaatttcaataaaccatgctgcaagcagatatgctgtcattcaggcttttttgttccatttctagagctgagcaggatggatttaacataattctttttcttttcttttttttttttttttgagacagggtctcactctgttgcccaggctggagtatagtggcattatcttgactcacgcaacttctgcctcccaggttcaagcaattctcccacctcagcctcctgagtagctgggactacagtcacacaccatcacactcgtctaatttttgtatttttagtagggacagggtttcaccatgttggccaggctggttttcaactcctgatctcaggtgatctaactgcctcagcctcccaaagtgctgggattacaggcatgagccaccacacccggtgaagatttagcataattcttaagggcctgtgatttttggaaaggtaaattagaattggcttcaacttaaaatcaccagctgctttaacccctaataacaagagtcagccaatcctttgaaactttgaaatcaggcattgacttctcctctctagctatgaaagtcctagatagcatcttcttccaatacaggattattttgtctgcattgaaaatctgatgtttaatgtagcaaccttcatcaattgtcttggctagatttttctggataacctgctgcagcatctatgtcagcacctactgcttcatgttgcacttttgttactggagacagattctttccttaagccgcaagaaccaacctttgctaccttccaacttttcttctgcagcttcctcacttctttcagccttcacagagttgaagagagttagggccttgctctggattaggctttggcttaaagaaatgttgtagctggtttgatcttctatccaggccactaaaactttctccatatcggcaataaggctgtttttctttcttatcatttgtgtgttcattggagtagtgctttaaatttccttcaaacacttttcctttgcattcataacttggctaactccttggtacaagaggcctagctttaagcctatctcggctttcaacatgcctttctcactaaacttaacgatttctagcttttgatttaacatgagagttgtgccactctccctttcactgacacttagaagtgattgtaggtttattaattggcctattttcaatgttgttgtgtctctgggaataggaaggcctgaggagaggcaaagagatgggggaacagctggttgttgggtaagtcagaatacacacaatattttttaattaagttttctctcttatatgggtgcagtttgtagtgacccaaaacaattaccctagtaacatcaaagatcactgatcacagctcattataacagatatcataattatgaaaacttttgaaatattgtgagaaataccaaaatgtgacacagagacccaaagtgagcacatgctgttagaaaaccaacaccaatagatttgctcaaggtaggtttgccacaaacatctaatttgtttaaaacgcagtatgtgtgaagcatattaaagctactgtcagatcaagcctcttgcagataataactgtattgatctgacaggagcttacatggccatgattagaagtggagccatcctgtaatatatctactcaacatgttttagaagagaatactgaggcccagaaagattaagcgaccttcccagtgtcacatgactagaaaataatagagctaaagtttaaatataggctttctggctcctgatccagagcatttccacatgttactttttataatttaccttttaattttatttttaattgacatgttataattatacatatttttggggtccatagtgatgtttcaatacatataatgtatagtgatcagatcagggtaattagcatatctgtcctctcaaacatttatcatttctttgtgttgggaaattcagcatcccccttctagctatttggaactatataataaattattattaactatagacatcttaacggtggtatagaagactagaacttactcctcccagctataattttatatcctttagatatcagtaatattctttctcaggcattattctcccagatgggtaagtcctgattcttttgtctctcctcatataataccaattactcccattaccttaatgagttttccttgtagatgtccactaaacattttccaacttccttctaatcttttttaggtttccactgttttccagtattggctttcattacataaaaagaggaaagtgtctcttgatttctttccaatgacctttttgaattatatcccagcaacatcttcagggaatggtttttgaggctttaaatatgatttctttgttaaaagtagaagcttagaaactgtaatcttacataattcagattattctcctcctaaatatgttactttattcacccttataggaaattttaccttttctatcctctcataagtctcattaggcctttctttttgtaatgtttcccatttgttgtagcctttcatatagaaagaactttatgtcctctgtaatcttaaacccatgttcttccagatcactagcaaaaatgttaagatagactgtgtggtattgtgaattaaaaaagcatcatggaccaggcgcggtggctcatgcctgtaatcccagcactttgggaggccaaggtgggtggatcacctgaggtcgggagttcaagaccagcctgaccaacatggcgaaaccccatctctactaaaaatacaaaattagccgggtgtggtggcacatccctgtaatcccagctactcgggaggctgaggcaggagactcacttgaacccaggaggcggaggttgcagtgagccaagatcgtgccattgcaatccagcctgggcaacaagagcgaaaaaaaaaaaagcatcatgacaggtgtacatatatgcaaaaactatttattgagtgcctactctgcactggtcactttgctgggtgctgaaggtataataatgagcaagacagacatagtccttgccttcctagggcttttatggtccagtagagaagtcagacaactaaacaagcaataaaaaataaaaactaagtgtggacatgggaggaagtgcagggtgctatggaagcacgtaacagtagaatctaacctgtctggggcgggagagggcagagaaaaccctccagattaagacagattctgatcccagttctgctgcaaccttatgtggctttcttgtcggtgctcctctcttggcctcagttttctctgagtaaataaagttgttgaacaagatagtcttcaacatcttttccaattagttaattctgcagtttcagtagtgatgcatgataccgttaagtgcagactttgaaggcagatacacctgagttttatactctctcgaccccaacttccacatctacaaaatgggaataatgactacttcagggtactggtatgagaattaaatgagatcagttatgcaaggctgaagttacagagaggacacagattaaacatgagccattttccttttatgccaatttcaataaataagcaacttaaagcattatctttgaagtaaaacatttattataaagtagaatgcaacgtttatatgaattttaagataaaccaaagaaattttctattttggtacatgccaccagacattagtaacattaatctctactgttctttttttttttttttttttttttgagacggagtctcactctgtcacccaggctggagtgcagtggcgcgatcttggctcactgcaagctctgcctcccgggttcacgccattctcctgcctcagcctcccaagtagctgggactacaggcacccaccaccacgcccggctaatttttttgtatgtttttagtagagacagggtttcactgtgttagccaggatggtctcaatctcctgatcttgtgatccacccgcctcggcctcccaaagtgctgggattacaggcgtgagccaccacacccggcctaatctcttttctcatgggtactttattgaaaaatttgagaagcactgtgtgaaagtacctagtatggtgcctggtataataatactctttattgagttcataataggaactcaataaatgatagatctggggagtgctcatcattacattttttaatatctagatcagtctcctttgtttattgtccttaaaattgttctcctggtcctacaacttctgtgttaactcatttttttgttgttgttgttgagatagagtcttgctctgtcacccaggctggagtataatggcacgtctcagctcactgcaacctccacctcccgggttcaagcaataatccctgcctcagcctcccgagtagctgggattacaggtgcctgccaccacacctggctaatttttgtatttttagtagagacggggttttgccatgttggccaggctggtctcaaactcctgacctcaggtgatccacccacctaggcctcccaaagtgctgggattacaggcatgagccaccatgcctggccgctcatttttgtttgtaagcaatctgtggtatatgaccttaaaaaaacttgaaaacccaaataaatatcatccattggtttcccattgaccatattcttatttacttcctcaaaaactcttgcaaatgaatcaagacatgatttctacttacagaaaataggttgcctttccccactgagttatgttgccatttacatatttggtcttatagattaaggtgtttgaactcaaaactaggagagtattttagaaccacagtaagcttataaagcccaactcctagtgtttgtgttaacaggtaaaggaatatcatggataaatattatccacagatgatcctcaaaccttcctttacctatcgtttgaacacatttcttcatcagaaactatataccagaggaagaaaattgactaaaatcacttttcatctacatcaagtaatcccagattaactctattttatgctaatcgcctcttcattccaaatttctatggcacttagattatcaattttttaataataatattgttaatataatatgttttaagtcagtctctggttttcatataccttgtgttttgctacccccaaaagatcacaaactcctacgtaagcatgaaatatattttgaggttctctttttatatatatcttattctataatgtctggtaatttacaagttctgtacaatgtagatgcttagtaaccatttgttaactaattttataccttctcatgggtataactactttgaaaaaggcaaaagaatatcagcaggaaagaaatggaagggaattcatgatggcaagtactggtgatgaaattatgcctaaactgaatttatttcccaaattccagaataggctaatccatcctttctgctaaaggaagctgaataccccatcccctgcttttttttttttttttttttttccagacagagtcttcctctgtcacccaggctggagtgcagaggcacaatctcagctcactacaacctccgtctgtcgggttcaagagattctcctgcctcagcctcccaagtagctgggaccataggtgtgtgccaccacaccaggctaatttttgtattttcagtagagatggggtttcgccatattggccaggcaggtctccaactcctgacctcaagtgatctgcctgcctcagcctcccaaagtgctgggattacaggtgtgaaccaccgtgcccggccaggaagctgaatacctattataagtgaaatgtaacttgaactctctgcaaagaaattgttattctgaaatcatctgccttactatgaagtgacagttctctaagaaatgtgttacctttttcctaaaaagagaaccttcactcctttagcagtcaagtgagttaatttcctttcagttttatcaaaaccatttccaaactccagcttagcttttcctgtgaagacagtcaactctggtggtatccgtacacacagactggtttgaaaaaaaatctctgggaaaattaaacctagggttcttttgaaagtaactgattggattcactctaaataaatttatttttgacagataactgagagtatttgtgactggctaacagcaggaactagagtagacttcgtagtctagcaggagttaaaacttgagaaatggccactgatgatgaaaacccatagctgatagataagtaaccatttggagtactacaaaagaaaagccactgataatttattgtattttttaatccccattacaaaaaaaaaaaactcttgggtgcatttataaacacacagacactaaacatgactgggatcacacctgggctattcagcttctccaaactcattaactgaaaagatatagattaattggagggagttcagagaagagtaacaaaaatgattaaggggccagagggattgatttatgagcaaagattaaaagaattttgtctatacaatttaactaagtgatgactaagggggaagagggtggggatacaactgtctgaagggtgtaaacaccaaggagagaggagaataatttactatgcaacatgagaatataactagggctaataagctataattacccaaaggaataacagaatacatatttcagggaaactcagaaccatgagaccgccaacttgtttctcaaggagacactggcagatacttataacattagtctcatccagattaacaagtatgtggtgtgaaacaatcattttatgccattgagctctctctttccccaccctcttcaacagtcttgctttttacattattgtggcatagttcaagtccagcctagtgcaccggtctatatagttttatctttgttagtgccgataagtcaaagtttaattccaatagtggccatacaagagcccttccttttggatttactgtgaatttaattgaaaagcatcaaaataaggaatcatatctgaagaggagaaaatcttggattctgcttcagaagtcatagtatttgtgttttggatctccaataataaactttcaaattatatttaatgtctagaaaagttcaattttagcattattgcaagaaaaaagacactaaaaataaatctttgtaggcttcatgatttgtgtaaactttggaatgtggttcttcagaaaacaaattagtctgtgggtaactgcaggctaagttatttggctaattcctattgtgctatcatgacattccagagcattgctatttaactttgccagataagattttgcatgtcactgcagtgagagcagcttcttttgtatgcatacttttctccttcttttcctttgtgttgggaatcttcatagggtgatcccagtctagaaataccattttttcccttcaccattgcattgacaagttcttctggttttatgttaaattttatacttccttgtcaacatttctcttaaataatatattaatgcaatattttaaataaaatttttatataaacgtttaatgttataatagttttacatttacagaaaagttgtggagataatacagagtccccatatactctatccccagtgtgcccctattacattagtatggtacatttgtcatatcaaatgacctaatactgatacattattattaattaaaattcatactttattcactgtttttagtttttacctaatgtcctctttctgttccaagattccatccaagatgccacagtacatttagtatccccttgactatagtaatttctcagactttccaatgaccttaacagttttgaggagtactagttaggtattttgcagaatgtccttcagttgggatttgtctaatgtttttctcatgactagaatggggttatgggcttttggaaggaagactacagaggtaaaatgccatttgaagcacatcatagcaaaggtacatactatcttcaacttggggaagctgattgaaaaaaaaaattttaagtacatagtatcaacatgacttatcactattattgttaaccttggtcacctggccaagtagtgtttgtcagatttctccactgtaaacttattttgccttttcatatttcactgtttgtaaggaaatcattatgcacagcccatgctaaaggagtgaggaattaggctccacctccttgatggtgaagtatctacataaattatttggaattcttctgcagttgatctgcctattctgacactatttatttatttatttatttatttatttatttatgtctagataaagtgatatttattttatactttgggttataatccaatacgctttattctgttgttcaaatcattctggctttggcctttgggaggtctttcagttggctcctgtgtccctttgatgtaccctcatgcatgtgggcttttattgaacacttcttaacttgatggcactacaagatgctacaggttcatatgtatatttcctgccccagttagtcctatgatcacccaattctccaaggatctctggttccttttattgggtattacaaaacaagatctgagtgctagatgtgctcattgctactgggtgtcattacttctaggccttctcagctgacagaggaagaaaatgtatgtgtatactagcccatgtatgtatacacatatctatgaatatttccatatgtaaccatctgggtctttactaagctaaacatgagttcatactgatgtccccagcgctaatacaataccacatggatcattctaaccttctctcctgcttgcgtgtaacttcctgttgccatccaccatccatttacttgatcatccgattccaatttgtggctatagtggtttcaggcttgttaattcacacctctgtggggacaactttatcaaatatagtagatgcttatctatggttccttttgtctttagtcttacaaactcatttccaaaattacttaggttgggcctttttcccccttgtccttcagagaagttgtttcatacatataattagattcttttgtcaaattctgtatcccatcctgagatcaatcccctgatgacttcttcttagattattttttaacttttgcatacattaagatttactttttggcctgtaaaattatgtgaagtttgaaaaatgcatagtgttgtatatccaccattacagtatcatacggaatatttcatcaccctaaaaatctcctgtgtcccacctactcaaccctccctcctcctccacatacctctgacaaccactgatcatctgtataccatctctacagttttgccttttccaaaatgttgcataaataggatagtgaagtatatagactttccaactggcttctttcacttggcaatatatattttacatttagccatgtctttgcatagcttgatagctcattcctgttttatcgctgaatagaattctattatatggatgtaccacagtttgtttattcattcacctattaagtgacatcttggttgcttctaattttggtgattatgagtaaggctgctataaacatttgtgtgcagatttttgtgtaatcgtaagtttcaaatcagttgggtaaatacaaaggagtgtgattgctggatcatatggtaaaactatgtttaactttgtaagaactgccaaactgtcttccaaagtggctaaccatttttgcaatctcaccagcagtgaatgagggttcctgttactatgctttcttgccagcaattgatattatcagtttttgaatttcagcctttctaatgagtgtctaatgatatttcatttttgtcttaatttttatttcactaatgacaaccttgcccacctttgagtggttataaactatgaatttttaaacaatagttttagttttactaattctctctttgttagaattgagggaacaatgctttcaaagtgttaggctttttatttatattagaaaaaggtttaaaattcaggctgctacctttttataaatgtgtcgatttgtgcttctgtactaattagctacaacgtaggcaaaggaagcatccactaaagtgaatgctaagtcaccagtggcagacagtgaatcacaagaaccttattggattgttgtgcacaaagtagagggagttttgttggtaagcaagatgcctataagattattgtttttctggatgtatccgggacttcattttattcttttttattcttccctctctcattaccatcaccacacacacacacctttctgtcctccccacctaaacatggaaacagcagtaaggaggactaaaatgtaatcagaatatatatgcagcatgactttttcttgctttaggaccagataaccatagtgactttcttttttcctattccaatgtgactagcggataaatgatttctttcacaactgttagttgtatctgattttgatggcctttcttaaaattttactttaagttcctgaatacatgtgcagaacatgcaggtttgttacataggtatacatgtgtcatggtggtttgctgcacctattgactcgtcctctaagtcccgtccccttgccccccacccccaaacaagccctggtgtgtgttgttcacctccctgtgtccatgtgttcttattgttcaactcccacttatgagtgagaacatgaggtgtttggttttctgttcctgtgttagtttgctgagatgatggcttccagcttcatccaagtcccttcaaaggacatgatctcattcctttttatggctgcgtagtattccatggtgtatatgtgccacattttctttatccactctatcattgataggcatttgggttggttccatgactttgctattgtaaatagtgctgcaataaacatacatgtgcatgtgtctttaaatcagtagaatgatttatttagatgatttatttgtagtagaatgatttattcctttgggtatatatccagtaatgagattgttgggtcaaatggtatttttggttctagatccttgaggaactgccatactgtcttccacaatggttgaactaatttacattcccaccaacagtgtaaaagcattcctatttctccacagcctcgccatcatctattgtttcctgactttttaataattgccattctgactggcatgagatcgtatctcattgtggttttaatttgcatttctctaattatcagtgatgttgagctttttttcatatgtttgttggctatgtaaatgtcttcttttgagaattgtctgttcatatcgtttgcccactttctgattggggttgtttttttcttgcaaatttcagttccttgtaaattctggatattagacctttgtcagatgggtagatcgcaaaagttttctcccattctgtaggttgcctgttcattctgatgatactttgttttgctgtgcagaagctctttagtttaattagatcccgtttgtcaattttggcttttgttgcaattgcttttggcattttcgtcatgaagtctttgcccatgcctgtgtcctgaatggtattgcctaggttttcttctagggtttttatggttctgggttttacatgtaagtccttaatccatcttgagttaatttttgtatgtggtgtagggaaggggtccagtttcaaatttctgcatgtggctggacagaactctcaacacaatttattaaatagggagtcattttcccattgcctctttttgtcaggcttgtcgacaatcagatggttgtagatgtgtggtgttacttctgaggtctctgttctcttccattggtctatatgtctgttttggtaccagtaccgtgctgttttggttactgtagccttgtagtatagtttgaagtcaggtaatgtgatgcctccagctttgttctttttacttaggattgtcttggctatacagggttgtctttgattccacatgaaatttaaagtagttttttctaattctgtgaggaatgtcaatggtagtttgatggaaataacattgaatctataaattactttgggcagtatggccattttcatgatactgattcttcctatccttgaggatggaatgtttttccaattgtttgtgtcctcccttatttccttgaacagtggtttgtaacaagttcttcttgaagaggtccttcaaatcccttgttagctctattcctgggtattttattctctttgtagtgattgtgaatgggagttcactcgtgatttggctctctgttgtctatttttggtgtaagggaatgcttgtgatttttgcacattgattttgtattctgagactttgctgaagttgcttatcagtttaaggagtttgggggctgagacaatggggttttctaaatataaaatcatgttgtctgcaaacagagacaatctgacttcctctcttcttatttgaatacccttatttctttctcttgcctgattgccctggccacaacttccaagactatgttgaatcagagtggtaagagagggcatccttgtcctgtgctggttttcaaagggaatgtgtccagcttttgcccattgaatatgatattggctgtgggtttgtcataaatagctcttattattttgacatatgttccatcaatacttagtttattgagagtttttaacatgaagggatgttgaattttatcaaaggccttttctgcatctattgagataatcatgtggtttttgtctttggttctgtttatgtgatggattacatttattgatttgcatatgttgaaccagctttgcattccaggaatgaagcaaacttgatcttggtggataagttttttgatgtgctgctggattcagtttgccagtgtttttattgaggatttttgcatcaatattcatcaggaatattggcctgaagttttctgtttttgttgtgtctcttcccagttttggtatcaggatgatgctggcttcataaaatgagttagggagtagttcctccttttcaatttggaatagtttcagaaggaatggtaccagcttctctttgtacctctggtagaatttggctgtgaatccatctggtcctgggctttttttttttttttggttggtagtctattaattactgcctcaattttagaacttattattggtctattcagggattcgatttcttcctggtttagtcttgggagggtgtatatgtgtccaggaatttatccatttcttctagattttctagtttatttgcatagagatttttatattattctctgatggtagtttgtatttctgtggggtcagtggtgatatccccattattattttttattgtgtccacttaattctgtcttttcttctttattagtctagctagtggtctattttgttaattttttcaaaaactcagctcctggattcattgatttttttttggagggttttttgtgtatctgtcctcttcaattctgctctgatcttagttatttcttgtcttctgctagcttttggattagtttgctcttgcctctctagctcttttaattgtgatgttagggtgtcgatttgagatctctctagctttctgatgttggcatttagtgctataaatttccctcttaacactgctttagctgtgtcccagagattctggtacattgtctctttgttctcattggtttcaaagaacttcttgatttctgctttaatttcatcatttacccaggagtcattcaggagcaggttgttcaatttccatgtaattgtgtggttttcagtgagtttcttaatcctgagtcctaatttgattgcactgtggtctgagagactgtttgttacgatgtcagttcttttgcatttgctgagaagtgttttacttccaattatgtggtctattttagactaagtgccatgtggcactgagaagaatgtatattttgttgatttggggtgaagaattctgtagatgtctattaggtccacttgttccagaactgagttcaagtcctgaatattcttgttaatttttatctcattgatctgtctaatattgacagtggggtgttaaagtctcccacgattattgtgtgggagtctaagtctcttcgaaggtctctaagaacttgttttatgaatctgggtactcctgtattgggtgcatatatatttagaatagttagctattgttgcattgttgcctttaccgttttgtaatacccttctttgtcttttttgatctttgtttttttaaagtctgttttgtcagagactaggattgcaacccctgctttttttgctttccatttgcttggaaaattttcctccatccctttgttttgagtctatgtgtgtctttgcacatgagatgggtctcccgaatacggcacaccaatgggtcttgactctttatccaatttaccagtctgtgtcttttaattgggccatttagcccatttacatttaaggttagtattgttatgtgtgaatttgatcctgtcatcatgatgctatctggttattgtgcacactaattgatgcagtttcttcatagtgtcattggtctttatattttggtgtgtttttgcagtggctggtactggtttttcctttccatatttagtgcttctttcaggagctcttgcaaggcaggctggcaataacaaaatccctcagcatttgcttgtctggaaaggattttatttctcctttgcttatgaagcttagtttggctggatatgaaattctgggttgaaaattcttttctaagaatgttgaatattggcccccaatctcttctggcttgtagagtttctgctgagatgtccactgttagtctgatgggcttccctttgtaggtgacctagcctttctctctggctgcccttaacactttttccttcatttcaaccttggagaatctgatggttatgtgtcttggggttgatcttctcatggagtatcttagtggtgccctctgtatttcctgaatttgcatgttggcctgtcttgctaggttggggaagttctcctggattatatcctgaagtgtgttttccagctttttgattgccttttaacactaatttaggtccttcctctctgagtatacctggtgctaccatgttgccccatctctccccaagctgcaaacttgtctttctccctttgtttccaattccatcttacccattctatatgccattacttcagggtcacactaggtaaaaaacaataatagtaattgtctaaatcaattttattttaaatgttaggggggaagaatacaactaacattaattgaacatctacaatgcaccaagcacttttatacatgttctcatttaattctcacaacaatcccatggtgattgttatttctgttgtatagatgccattaatttagaggtaagtggcatgctttaacccttttgtacatactattccgtctgtctaggataccccttcagttccatctctatcgagcaaactaccaaaccttcaaaagccacttcagatgtcatctccctagctggtggtctcagcactgcccatgtcaattctgaaaagactctccaagtaattctgatactggcccctggttaagagtcatcatatgaaacaatactgtgtaaagagcaagagccacgtcttactgatatttgtattcctgttgcattgcagagtctattttgcattccacagtagtattttggtcagtgtttattgaaggaattatttgaggtttatggaaatgcccatgttatgttgtatgttactgggggtgggtagattttgaaaaattcaagtaaatgtattcagataaatgctacatctctggggagcagtagaagtgaaaggtggtgataactatgaatgaaacccatataaacacagaggcaacaatttttagaaagaagagaatgcttatcatatttttattctttttggaaacaaactacttctctcataatgcaaactaaaaaaagtaaaatttgataaagtctgtttggctggtacaaatacacagcacataattgtaaaccagggatatttccttgggaaacggattgccatcagaaaaagagactgcatgaaatgtttaacatttattaaagtggcataggttaaagtgttaaatagctgaaaaacactgaagtaggaactcatagaaaagtttgggtagcctactatcctttataaaaagcagggtctttgttgattcaaaatacttggttgccttgggctctatggtattgaatgttgctaaaaataaatgcgccacctacttgcacttagaaatttcttcattctataaaagtttacattgtgttgtaacagaatttgacctttattggcaagaaataatgtaaaacatttctaatcaattctcaagcatgatatggcagcactttccacacaactaggtaccagctgataagagatgagatctctgattactatttcagcagttaccattagtacaagtaaaaatgaatattgtgactggcaagtgctcaaggattttagtactaacataattatttattgcttagaacttggctctgcatggtccaagttcaatgtcaatttaagaccccagcaagatactgtacagctgacttcatttgccaaagaaatttgaaaacttttttaaagctattaaaagcattcttgctgttttttggcagtgctaggtagaacttggctcatcatggagctgggataatcacagagtgagcgaatgataatttaggtccttaggcaaacatacaagctttgaagcctgggtatttctaattgcatgcctagtacctgattgacatgattctgaggttaaacaactaccctgagaagctgctcctagttgccgattgtttaccagtgaccttccactcctacacatagaattgtgtttcacctactgacagtggtctgccaaagtccaggatgaatcttcctggagtgtagattctgctcagggttaacagaaaacacttcacttcattctatttttgtgtgtgtgtgtgtgtgtgtgtgtgtgtgtgtgtgtgtgtgtgtgtgatgtataatgcaaaattcttctaaaatgggagacttcaaagaaatgttaggacttaagcctgtccctcccactcctgccatggggagacggcatttggaagtgtggagaatcttaaaaacactgctctaagttatggccacttttctggaatgctgttatctctcacctctgcccagaagtatcctgcttatttttcaaaagtcattgtccccatcttctgtaccccaagcagagttaacacttctctgcggctccgtagactttcctttatgaacctcatatggcattcatcccattgttgtgattgcctgtttgtcttctcactaggtaggtggtgagcctcagaagaacaaggtctacaggttctttatatcctcagtgccttgcactgtatttgactagagcaagtaactagcaaacagtgaatagtgaataggtagatggataactggatgatagaacagacaggaaaatgtccattgatatgtccacccacgtgaataagattctgagctcctctcctaatattctagtttaggcctctgaatatagaaatgggtgttcactgggctgttttcaacttgcatatcagttatacccttacttttaatggggaaatatcaatgtaattcattctattaaggctcaggaagaaaaatcatatgatcatatcaattaatgaaaacaaagtatttaacaaaatccaataccaattcatgatttaaaaaaaaaaagaaactcccaaccaactaggagtagaggggaacatccacaaattgataaaggacatctacaaaagttctacaggtaacatcatactttatggtgaaagactaaatgcttttcttctaaaatcaggaacaagattaagatgtctgctctcatcatttctagtcaacattgtgctggaggttctagccagtgaaataaggaagcaataaataagaggcaaccaatttagaaaggaaataaaactgtctttatacacagacgacatgattatctttgtaaaaagttgtaagaaatccacaaaacaactaccagaactagtaagtgaatacagcaagttcacaggatacagggtcattattaaaaatcaattctattcctatatactaggaataaacaatcagaaattgaaaattttaagaataccattcttaatagcatcaaaaatatgaaatattaagatgtcagttttcccaaaattgatctatagattcaatgcaatttaaattttttataggaactgataagctgatctgaaaatttatgtggaaagtctgagtacctagaatatcctaaacaactttgaaaaaagaacaaagttggaggacctatgctacctgatttcaaggcttattagaaagctacagtacatagtgtttttaatatagacagtagatctggttgcagaatagtgagccaagaaataaacccacacatatatggtcaaatgatctgcaacaaaagtgtgaagcaattcaatggaaaaattatatttaaaagacaaaatacagcatggaagaaaatatttgcaaatcacttatctgataaagaactgttatcaagaatatataatgatcttttaaaaaatcaataataaaaagcacacaactcaatacttttaaatggaagaaagagagtcagggacaatggtggatatctgtaatcccaactacttgggaggctgaggtaacaagatcacttgagcccagtttgaaaccagcctgggcaacatagccagatcttgtctctaaaaacaaataaacaaaaaatttaaatgggtgaagtatttgaaaagacacttcactaaagaagatatatgaaaagatcctcaacatcattagccatcagagaaatgcaaattaaagccataatgagagactactacatacctattagaataattaaacttaaaaagactgaccataccaagttttgatgaggatatgagaacctgaaactctcatacacactgctggtgggaatgtaaaatggtacatccactttaggaaatagtttggcagtttcttataacatgtacttaccacatagtatatgttacccaacagttctactccaaggtatttcctaagagaaataaaagcgtatgtccacacaaagacttgcacaccaatgtctgtaacagttttatttgtagtaactaaaaactggaaacaaatcattttgtccctcaacagatagtggataaacaaactctgttacatccatgcaacagaatactacttatcaatgaaaaggaatgaactgatacatattataacgttagaatctcaaactaattatgctgagagaaagaagcccgacaaagtatcttgtgtgatgctatttatataaaattctagaaaatgaaaactgatctatagtggcaaaaagcagatcagtcgttacctggaaatgcagagggcatcagagactgggctgagtgggaagggattacaaaggatcatgaggaaacttttgggggtgatggatatccttgttattttgattgtgatgatggtttcacaggtgtacatagatgtacatacatatgtaaaaacttaaatatgtacaatttgttgtatgtctataaagccgtaaaaatgatctctgtggctgaaaatgaagctggttataacttaatctggagtgtgtttcaggtatcagtgggttataagagaaaggatatagataggctttgaggctggagttaaagaggcaggttaaataatagagacgggctattctttagttggcttcttgccagaacgctttttcagataaaggttctgagagactgatttaaatttagtaatggcaaaggaagatttctgttccaaggttactaattggtttttaaattgccatatgattatttttatatcttatgagtaatacatgcacatagtttttaaaaatatgaactaagtacctaaaagtttataatgcagacaatgtttcactgttccaaccctccgaatcctaatcctctgagattacctttcactctattaactgtttctgtttagttcttctattgactgcttccatatatactgctatttcttaattcatctattttacgctttattaactttgtaatttaataaatgaggctataactcacttatactatctcttgtcccaatttagttatgatgctttttagttcctcttctttttttttttgaggaatatacttagacctttatttcttgtttcgtaaactatagacagtatctcttagttctttgtaaaaactaagagtttgtaaaaagaggccattagttccctttatctctctcccctacctgccaattctagtcatgtgtacttttactttttacattgccaagagtggtaatgtttatgttttgctctacatttataattaactatctctataattaaatatcctgtgcttttatatattggttatttccagaagttgaaaatcaatatacagtgtttgtactattgttaattatttaaaatttttctctcttctgtcaagtgttgatagtattacatttcttaatttgtaaaacttgtttttttctggattttctaattacctttattttttcttgcatcgtctgctacattcataagtttctctaatttcttaaagatggataggcctggcgtggtggctcacgcctataatcccagcactttgggaggccgaggcgggcagatcatgaggtcaggagttcgagaccagcctggccaacatggtgaaacaccgtctctactaaaaatacaaaaaattagctgggtatggtggtgcctgtaatcccagatactcaggaggctgaggcaggagaatcgcttgaacccgggaggcagaggttgcagtgagctgaaatcgtaccactgcactccagcccagctgacagtgagagagaccatctcaaaaaaaaaaaatggataaaatggtgaatccttttccctgtctttttcttgatgcctctctcttggagccccccttccttccattcagacgaagtgttccttaggcctctactgtatggctgggacttacttttattagtctttgcaatattaaaatgtcatgtttttgttatcagactcaactgatagttggttaggacaaaattataggtttgaaataattttctgtcataattttgaaggcattcctccattgttctctctaagagccagcgttgctgatgagatgaccaagccattccaattcttgttcccttaactattaatgtttttcctctctgggagcttttaggatcttttctatatctttgctgttctgaaatttcataatgtgtgtaggggttgagcaaaatggtttagtaccccagatataaggcctgcacctcaataagccccaactatgtaaatagagccattatactgggggacctctaaattccagatagtagaggtctttgttttacagcattaatgcccacattagttacttcaattcttcttagacaatttattcaatctctttagagaagaaccttctgatttttttctttgccttgggaatcaatgcctgaatactagcagttctatatgcagtggaggaaaatgattaatatacagattttcaatgaatttctcatatttcattttcaccctctgccttacttgacatttccaattttcaaacttttctgtgatcctacagggcagaccaacatcctcccaagctgtaagccccctctgtcattttatctgccaatctttatcagccagcatcctattcaatgtctgtctatcagaaatgtattgggatctcttttctgctgactccctctactattgtcttcattatatcttttttattgtttaatgtcattgttaaatttttttatttttaatttttgtgagtacatagtaggtatatatatatttatgggttacacgagatattttgatacaggcacacaatgtgtaataatcacaacaaggtaaatgcagtaaccatcacttcaagcatgtatcccttctttgtattgcaaacaatccaattatactcttagttttttaaaatgtacaatattttaaaacgtacaataataaaatgtacaatgattgttgactgtagtcaccttgttatgctatcaaatactagatcttattcattctatctaactatattttttaccctttaataatccctactcccccacccattactacccttcccagcctctgataaccatcattctactctacatccccacgagttcagttgtctttattgtttagctcccacaaatgtgtgagaatatatgaagtttgtctgacttctttcaattaacgtcacgacctccatttccctccatgttgttgcaaatgacagtatctcattctttttatggataaatagtactgcattgtgtatgtgtaccatatcttctttatccattcatctgttgatagatacttaggttgcttccaaatcttggctattgtgaatagtggcacaataaacatgggagtgtagacatctctttgatataccgatgtcctttcttttgggtatatacctagcagtaggattgctggatcatatatggtagttctatttttagttttttgaggaacctccaaactgttctccacagtgattataataatttacattcccaccaacagtgtacaagggttccctattctccacatcctcatcagcatgtgttattgcccgtctttttttataagaaaacatttttgaagcctttatttacaaaagctttaaaaacaagtaataccctctgttttgaaaataatgttttgtttaaaaaggaccacccagttacagcactgtaatatcatgagtaaagaatgtacaagggagacaaaccaatgtgactaacatttggagatttgctaatattattgattgaagtataggtaatacacattataacttgtagtcaatcatttcagggtagggttaatgattaccgaaaagtcttcctacatcctacacatgctctggtctggtcacatattctgcatggctaaatatttcacagtctcttttgtcaatatatgtaaaatagattgcaaagatatacacaaaaaaaacaagcattacactcctcaggtaattttattagctctctctctctatatgacaatatatatatattctcatatattctcaagcatcaaaatgttatacttgactgaagatttgtttcagaaaatattttatcctttatttatgtactcatatatatatgagtacattatatatatattatatatatacatttatatatggattttgttttgtaccaaatctctccattatttacctttgtagcaactaggaaagcacaatttttgacttctaatttaatttggtacaaaatatacctaaagacttgttatctttggattttaaaaaaaatcaatttgtataaccaacaaatcaagagcatcataagtatggctacgaaattaaaaaaacaagggtaaacagtgatggaataaaaataagcagatcaagggaagtgtgctatcataaagtaactgtagcttcaacatcttgagtaccagtttcctggcagatactaagtattcaatcacaaggaatttttcctgaagggggtaagactggtttgaaaagtcttcagtcacagagcagcctacacatgccaattaaaaactgacagacactagatgtgcttggaagattaaacattatgtacagaaacagcagttactaagctcctcagtagtttcttgtcttttttttagtttcactgaattgacagtttgcacaataaatgtgctacattctgtgggtcaaaaccgagtaaatgctgtgtaaagttggtagatggtcatttttccagctaagatcaagtaaaaacaacatttctgataaaacagaggttttgagttagaatcactctccaaagtacaaaactgatggtccacaatctcaaatagctaaaactcctgcagaatggaagggagagacatgaaacagagaaataaattacagtcagtgctagttaatttaggaaaagggagaaataaaccaaactcccaagtaggtaaagtttatcaaaatattcaatgatgtagctttctccactctgtcacacacgcttgctaacaagtatattaaattaaggccaaatttaacctaaatgtgtttttttgttgttgttgtttgtttgttcttttgtgggtttttttgttttctttttttaatctgagataggaacgatcatacttagtactgaaaggcagacaataaaatgggccatgaaagggcggggggaagggactgtctgttgttcaaaggattcaaccagagataaaacctatatacaagcatgtgtgtagctcaaaataaaataaaaataaaaggactatttcatgtcatgactgcttgttggcttcttcttcatatgcattccctgtgccattctgtacataggatgaaccagaaccaaggccatacaaatgaccacaatatttggcatcatcagtatgatcttcaaagaacattcctctcattttgaaaaaggccattcctgtcagcaatgatttagatcctgcctgatgtggtggtcctatctatgccagctctaactgttctgccacctcctgtaatccatctttgagatgtttgcagctcttcatgaggtacttcacatcataaatgacaggtaaaaacaatcgaaggatctcaaagaagtcaagttcttcttcaggcaagttagagttggtcagcattttgattaaatagccaaagttgtaactgctgtgaaatgacaaccatttgaccccttcacagaggaccactcctgaagtcataagaagttctgcaaagtactgggtctcaattccttcctcatcatgttttttaaactggataccagatgttgttagtagctctatagagttctgggcatacatgtcctctgtcaaattaaatttaaaattaaactgccaagttgaagttcctggagggtattctccttgctcatttataaatgtcagtcctagctgaattatctttaacaagtctacattacaccgcaatagttggtattgatagtcagcattgctcctgaatcctccagtgggtcttgcaaccacacctggaaactcggtgtccatagcaacgtaattatattttcggataacttgatgaattttcttcatctcttcatccacgttgcaagcccaaacttcacaaattctttggctatgatgtacagttgctgctggcatagtgagggcacaagggagtctagatgccaagcatcaaaatgttatacttgattgaagatttgtttcagagaatattttgtcctttatttatgtacttgtgtcactgagctctcactcctcctcctccccctggccatagagacagcacccggcggcagtggcagtggcgggtgccccatagacacctctcgcccagcaagggatctgcaccacaccgtggtgcgctgtcacttttcgcaccgcctgtcttttgaataaaagttaaaatggataaaggccattttcactggggtgagatgatatctcattgtagtttcaatttgcatttctctgatgatagatgatgttgagtaccttttaatatgcttctttgccatttgtatgtcttcttttgagaaatgtctattcagatcttttgctcattttaaaatcgaattattagattttttttcctatgaagtggtttgagctccttatatattctggttattaatctctgtcagatgagtactttgcaaatattttctcccattctgtggattatctcttaactttgtggattgtttcctttgctatgtagaagtttttaatttgatatgctcccatttgtccatttttactttggttgcctgtgcttgtgggatattaaatttttgcccagtccaatttcctggagttccctcaatttttttctattagtgtcatagtttgaggtcctagatttaagtctttaatccattttaattttatctttgtttacagtgagagataggagtctagtttcattcttttgcaaatggatatccagttttcccagcaccatttactgaagagactgtcttttccaaatgtatgttcttggaacctttatcaaacatgagttcactgtagatgtatggatttattccagggttctgtattctgttccatagtctatgtgtctcttttaatgctagtaccatgctgtttgggttgctatagctctgtattacaatttgaagtcaggtgatgtgattcttccagttttgttctttttgctcaggatagctttggctattctgggtcttttgtggttccatatacattttagaattttttttatttccatgaagaatgtcattgatattttgatagggattgcattgaatcagtagatagcttggggtactatgaatatttaacaatattgatttttctaatccatgaacatggactatcttttccattttttgtgtgtcctcttcaatttcttacgtcaatgttttatagttttcaatgtagagatatttcacttctttggttaagtttattcctaggtattgtattttatttgtggctattttaatgggattactttcttaatttctttttcagattgtttgctgctgacatatagaaatgctgtgttgatttttttttatcctgaaacgttactgaacttgtttatcagttctaattgtttttttggtggagtctttagttttttccacatataagatcatttcatctgcaaataaagataattcaactttgtcctttccaatttggatgccctttatatctttctctcatccaattgctctagccaggacttccagtactgtcttgaataacagtggtgaaagtgggcatctttgtcttattccagatcttggagaaaaggcttccagtttttccctattgcgtatgatactaactgtgggtctgttatatatggcttttattgtattgaggtatgttccttctatacccagtttgttgagggtttttatcatgaacagatgttgaattttatcaaactcttttttcagcatcaattgaaatgatcatatcatttttgtccttcattctgttgatatgatgtatcacattgattgacttgcatatgttgaaccatccttgcattcctgggataaatcccactttgtcacagtgagtgatctctttaatgtgtcgttgaattcagtttgctagtattttgttgaggatttttgtatcaatgtttatcagggatattggcttgtagttttctttttttgatgtgtttttgtctggttttggtatcagggtaatactggccttatagaatgagtgtggaagtactccctcattctctattttttggaatactttgagtaggattgatattagttcttttttaaatgtttgataaaattcagcagtgaagcaattgggtcccaggcttttctttgctgagagatgttttattacaacttcaatctcattatttgttattagtctgttcaggtgatggatttcatcatggttcaatcttggtaggttgtatgtgtctaggaatttaccagtttcttctagatttttcaatttattggcatacagttgttcataatagcctataatgatcttttgtatttcttcagtgtcagttataatgtctcctttttcatctctaattttattactttaggtcttctctctttttgtagttagttgggctaaaggtttgttgatttttttatcttttgataaaaaaacttttcattttattgatcttttgtatttttatttcaaatttctactctaatcattattatttcttttcttctaattttgagtttgcttcggtcttgcatttctgtttcttttttaacttttgtgagtacatagtaggtgtatatatttgtgagttacaggaggtattttgatacaggcatgcagtgcataataatcacatcatgataaatgaggtatccatttcctcaaacatttatcccttgtgttacaaataatacaattatactattttagttagttttcaatgtacaattaaatgcaattctagttctttaagatacatcattaggttgttcatttgaaatttttctagttttttattgtaggtgcttattgttataaactttcctcttagtactgctttcactgtatcccataggttcttgtatgttgtgtttccattttcatttgctgcaagaaattttttaatttccttcttagtttcttcattggcccactggtcattcaggagtatattgtttaatttccatgtgtttgtataatgtccaaaattcctcgttattgatttctagttttattccatcatggtcagggaagatacttgatattatttcaagtttttgaatgttttaagacttctcttgtggcctaacatatggtctatccttgagaatgatccatgtgctgagaagaagaatatgtactttgcaacccttggatgaaatgttacgtgaatatccattaggtccatttggtctatagtgcagattaagtctgatgcttctttgttcattttctgtctggatgatgtatccaatgctgaaagtgaagtgttgaagtctccatctattattgtgttggggtctatctctctctttaactctaataacatttgttttatatatctgggtcttccagtgttgggtgcatatatacatatatttaaaattgttatatcctcttgttgaattgacccctttatcattatataatgaccttctttgtctcttttatagcttttgtcttgaaatatattttgtctgatagaagtatagctattcctgctaatttttttgtttccattagcatggaatatcttttcccatccctttattttcagtctatgtttgtctttatacatgaagtgcatttcttgtaggcaacagatcattgggtcttgattttttatccacttagccactctatgttttttgattgaagattttagtccatttacactcaatgttattattgataagtaaagatttactcctgccattttattacttgttttatatttttgtggtcttctcttccttctttcctttcttcctgtcttccttctagtgaaggtgattttctctgatggtatgatttaatttcttgattttgattttttgtgtatctgttgtacttttttatttaagattaccactatggttgcaaataatatcttataaccatttattttaaactgatggcaacttaacaatgattacatatacaaacaaactaacaagcaaagagaaaacgaatagacactctacactttaacttcatccccccactttaaaaccttcttttctatttatatcttattatattgtctatgtcttgaaaagttgtcatagttattattttttattggttcttcatttagtctttctacttaggataagagttatttacacaccagagttacaatgttataatattctgtgttttcctgtatacttactattaccagtgagtttcgtatgtgcaggtgattatttattacttattaatgttcttttctttctgattgaagtactccctttagcattttttgtaggacaggcctggtgttgaaatccctcagcttttgtttgtctgggaaagtctttatctctccttcatgtttgaaggatattttcactgaatatactattctagggtaaaaggtgtttttttttccttcagcactttaaatatgtcatgccactctcttctagcctgtagggtttccactgagaagtctgctgccagatgtatacagctccattgttatgttatttgtttcttttctcttgctgctttcaggatcctttctttatccttcacctttaggagtttgataattaaatgctatgaggtagtcttttttgggttaaatctgcttggtattctataaccttcttatacttgaatatggatacctttctccaggtttgggatgttctctgttatccctttgaagaaagtttctgccctgatctctctctatctcttctttaaggcaaataactcttgtatttgcccttttgaggctattttctagatcttataggcatgcttcatttttttgtattcttttttcttttgtctcctctgactgtgtattttcaaatagcctgtcttcaggcttactaatttttgcttctgcttgatcaattctgctagtaagagactctgatgcattcttcagtatgccaattgcatttttcagctccagaatttcttctttattcttttgtttcaatctctttgttaaatttatctgataggattctgaatttcttctctgtgttagcttggatttcattgagcttcctcaaaacagctatgttgaattctctgagaagtcacatatctcattttctccaggattggtcaccaatgccttatttagttcatttggtaaggtcttgatgcttgtggatattcatcgatgtctgggcattgaacagttacgtattgactagtctccgcagtctaggtttatttgaacccatccttcttgggagggctttccaggtatttgaagggacttgagtgttgtgatctaagtctttggtcactgcagctttagggccaccccaagcccaataatgctgtggctcttgcagactcatagaggtaccacctggtggtcatgggtaagatctgggagaattccctgaattgccatacagagactcttgctctcttcccttactttcccccaaacagagtctctgtctctatgctgagctgtctgaggctaggagaggggtgacacaaagcaccactgtggccaccaccacctggactgtgctgggtcagacccaaagccaagatagcactgagtctcaccccaggcctgtggtaaccactgcctggctactgcctatgttcactgaaggcccaagggctctacaatcagcaggtggcaaatctagccaagcgtacgatattccattcagggtggcaagtctccctggccccagacaggtccaacgatgccatccaggagccagaacatggagtcaggaagcataggaacctacttggtgatctattctactgtggctgagctgacacccaaagtgcaagacaaagtccttcccactcttccttaccctttcctcaagcagaagagtctctccctgtggctaccactgcctcaggcccatggtgagtactgcctggctattgccagtgttcactcaaggcccaagggtctttagtcagcttgtggtgaatgctgccaggcctgggactcttccttcagggcagtgggctcccctctggcccaggacaggtccagaaatgccatccaagagccgaggcctagaatttgggaccccaagaacccacttggtgctctaccccactgtggctgagctaggacctaagctgtaaaacaaagtcccttctactcttccctctccttttgtcaagcaagaggattctctcatagccaccacagttgggaatgtactgggccacacctgaagccagcacagctgaatctcacacaaggcccgtgttgagtactgcctggctaccactgctggtttttcaggggccaaaggctcttcagtcagcaggtgatggattctgtcaggactggatccttcccttcaaggcggcaggttcccttctgacccaggatgtgtttagaaatgtcctccaggagccagggcctggaatgggagccttaggactctgcctggtaccctattctactgtggctgagctggtatccaagttgcaagacaaagtcctctttattctcccctcgcctctcctcaagaagagggaaggaatctctcctggagctgtaagctgcactgcttttggttgagggaggggtgatgcaagcactcccttggcaccccagctgatatatcactagattacgtgcattccaagctgctgtctccaaacccagcacagcaccaggacttgcccaggaattgctgtccttgtggcctagactgcctttaaagtttatttagaaccccaaagcactttagcctacagtattagggcttgccagaactcaggttccaaccactgggatggacagttccaaccactggctagcactggtctaatgctccttccatggttgccagctgagttctgccccaggttgctttccgctgtgacagggcagcactgagtttcaatgcaaagtcacaatcactgtgctctccctccccaaagtgcagattctctctgtgccacatggccactgttgggggatgggtgagaggtggcataggtggttttaagactgtctttcctaccctcttcactgcctctttccttaatatgatgttaaaactaggtactatgatcactcatctgatttttggttcttattaaggtggtttctgtatggatatttgttcaatttgatgttcctgcaaggggaggggatgatcactgaaggctttcatttggccattttgctccacctcctccacctctgtttgtctgtttaatgtcattttaatgggatcttgggagagagaggagctaaaactgtttggttagttaccttgatgcagataactatatacttgttaaattttaaagtttatggagtttctgtggattttttggaaaatatttgtaattaggagcaattagctatgaactggacaaacctacattgtttatccatttatagaaatcaaaggattcgttagagttaaagctctgtgaaagagattagtataaagcattgaaatctaattctccattgcttcatggaaagatatctttagtccctaatactaaatcaaacaatggatatgtataaaattgactctaatgaatagggtattttgctatacttcatttcatttgtttatattttatcctaatttctttttgagtgggttgctccattgagatactatacaaaatattcatgagacaacactcagcatactttcttcactcactttcatggtcacaagcaagagtcaggaattttcctctaagaaaatgacatttccacagacatcctaatgctggattccagtcagtagccatattgaaaaaaattgtctctcaagacatttgtctctcagttttacagccactgaaatagtattggcctgccattacgtcacataatgaattattttgtatttacctgaagggaggccctggacacacctggacacatggggcactaaaatgccaagctagcagagaacagcattgcagctttggatttgtctaatctcacagtggctttgctggtctcgtgtttttcttgccagtccttttatgcccttggtgattctagtgttatagtctttaaaatcctgaatttgtgtcccaggccctttactgtttttcccaatcctcgggtttgtttcaggcttttattatggactaaatccttgctgattaacctgcctgcccctaagatacctgtatcttaaactcttctttgaattcaatctgcgtacttatagcctatcctgcctgaccttttcctctgaagttatttactgatctctgagattcactttctatactcacattcctgtgagccagtcctggattaatggtccactggccacgtatctacattcatatccttgttatctacccaagcccatgagtctatttggaccattgtttctagtctttctttcattatctgagccctagttataacagttgaactctagtctacaatgtatttcaatatcaatgtaaactgaatatcactcatctttccttaaaatttttcccactacttaatttttttataatatttggaacatttttgccttctcagaatcagtagtcatctgtttcttaatttgcttcttatttgtatcctattcccctcccccaagttctgactgttgcaactctgttttcactaactacctcacttttctctttccttcatatttatctagaatgttgtagtcagatgtggcttggggtagtttatgtggtgtaagtctccattggcagcagaatggatttcgtagaatgctattaatagtgaaattttggacaaggagaaaaaaatcctagtttaaatatattgctcaggcaatctcattttagtcataacgctactctaacttgtgctaatccagcttcataaaggtaaactgcaacatcattatcaaatatttaagagccatttaacaattcacaattaagaggttgtgtttgagctaatgttttctgaatccagagctcatttaatttataagctactcacaaatgattgcctttagtgatttccaggtactataagtggaagagtatgtttttctctttatgtgccaaagcacctttcactttagaagcatgaggaattacaaaataaataagcacacactcccaagggaaggcagtgtcatccagtatatattgttgcccttccttttattcaaagatgtcactactgatctaatccactctcatggggagcaaagactaaatcttcaaccagaagtcctttctatatgacatacatacaaaccattttttttatttgtgtctgcagctgctacttgtagagcctgtcactggatgtatttctgtgtttgacttgtggtcagctgaaagcctttgctcaaaaagttcaaaaattccatattgttgcattccaagctggtctctgctgctgttttccccagcagcccacagctatgttaatgttagttagagctattctataatacacctttagagtatttcttatgccacccctgcttatggttatgccataaagctcaccataccaaagatgctttggtttccttctgccattgtatttctacgcatgtcagcaaggaacagtgatttaatgctgatagagaccaactgacttccagaatctcagtagtagtcatcccctcttaccattttacattaagcatgactctgactctgacaataaaacagttcaccaagtagatgtgatatctgtggtgggtgtaaatttcaaagtcatacaaaagctggacccaacttatattttccattgatgaggatcaattcagtaagcttttagtttttcagctctgttctggatgttaggaatcaagctagacctaggaaacaaaaagtcagggcaggggtccattttccccctttgcattaatagttttatgtttctaataactcatctttctccttgatgtacatcttaaatagatttcaccctgtccagaggacaagtccacactggttctggacccacaaatatacctgccattgaggaggcatagcttactacctatgggggaagaaaaaatacaattaagatatataaggcattatttgataaatgtgaggggatctgttctgccccaaaatgggatctaagaaaagccagagattgaactggtctgtagtacaatttcacactggtgccattccatggtaatcttcccaagtaaaaatactttttttattttcctttctactttgtagttacttgcattgttgggcagtgatttttaagtcaaactgcctaggaagcagaattcagtgactgcttttagctctatgtgatgaaaaaatgttggttgtgtttagattccacatttagcgttactccgtaatttcagtcatcctctgacatatctacaacaagacatggcaatccctggcactcacatcagagatgtccaagatgccagtttcatttggcatttggcctgattgctgccaccaccacccccaccccactggtgacagctcccatgggatgctatgatcaatgttgaatgtccttgtttgcttactcccaggagttggcacactctgttcagcaactagcacatactgtgcttctattgttgtcacactgtttttgaaaccttactacctcctattgtgtagtgctgtcacagctacaaaaaaaccacaaaattgtttgtatgttgtttgtctatgtatattaaagatagattctagttcagtgccttccatatggtaagtactcaatgtttattcagacaacaccaccctgaatgaccttctctagaccttttgttgataatcaaagcatgtcgagttaagggttcttatgattaaaagtgcgttcaatgccatcttttgtaatcattttatatctatgacatatctatcatggatatgtaccaatgagacaaccctgtttcactcattggtgccaggatgcttatatcttgctatagtgaaatcagagattttcttgaatgtttcagggcataaatggtttaatttatttgaaggtcccagctgataggtcatggatgatgatagtgatggcagtggttgcaataagaaaaatagattttatattcaacaacatgaaagagaaatcattttgaaaaataatagatgatttgctgattttacagagcctggtatgtacctgcctcctcttgaggggcatgaagtaccaatttcataaatacattaactctgggaatgatagaagaaaaggtgaaaaacattagctatgcaagacccctattttacccagaagaaaaaagaggactttgtttttttagtctaaaggtaatgaaccgattgataaatgaacaatacagctgtttctcaaagtttagttcaaggattgggtgcacccctagtgagcaagttgaaaagtcagattctagggttccacctcagactgactttaaatttgggaagggtaaggcctaggattctgcattttgacactcatgcctagtgattctgatgtacactgaagtttgagaaccactgacctatagggttctcattcttaggatccttttgacttgattcctgccaatagtgtattgaatccttagtgtactctccatgatggatctcaaaaactaggcccaattagagtcaaaaaaaaatcttggctttaaggaatggattggtgatagtccgctctctggtttaagtatgtcccctccaaaatgtaggtgttgccaatgtggtggtattaagaggtgaggcctttaagaggcaattaggccattatggctcctaccttgtgaatgggtttaaggtcattttaaaagtggctttacgctatttaataaatggtgctgggaaaactggctagccatatgtagaaactgaaattggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgacataccatctcacaccagttagaatggcaatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaattgaacaatgagaacacatggacacaggaaggggaacatcacactctggggcctgttgtggggtggggggaggggggagggatagcattgggagatatacctaatggtagatgacgagttagtgggtgcagcacaccaacatggcacatgtatacatatgtaactaacctgcacattgtgcacatggaccctaaaacttaaagtataataataataaataaaaaaagaaaaaaaaagatatgaaagtctcttatcaccaggctcaaacaaataaagatcctcaataaagaaaaataaaaaaaaataaaaaataaaagtggctttacgcagtattcagctctctcgcccttctgccttccatcatgtgagtacacagtgttcctcccctctagaggatgcagcaacaagatgccatcttggaagcagagagtagcccccacttcataatcaaacctgttggcaccttgatcttggaatttctagctcccagaactgtgagaaaataaatttctcttctttataagataccgaatctctggtatttcattataacaacatgaacaaagacaatctaattattctttcaagagagtgagatttattagggcctattatgtgccaggcccagggctaggcactagctatacaaaaatggatgtgtgatcccttccctaaagaggcttatgagtaattttctatgaattatctagtaaaatcaaggacattagccatgaaatagaaaatgaattaaatttactctatgtcatggtaccaaaaaagtaccaaataattttgtgggtttagatatataaaaaatatgtttgtagaagtgtctggagagtcactagcaataatggatgtatccctcatgtctcactatgaacgaactgtttccagctgagatccctgtaatttgcaggtgctgtttaccatgtaattttaccctaggaaacaagggtgtaatcacttaataaagtgtaaagaattagatttttttcccccttgagcaaaatgcctggctgtggccaacattcctgatgcttcctcccttgtgcaataggaaagcaatattctaaaagagaagactgttttattcatatcctgcaacttgcctctggaggctatgctaatgaatgcaaaactcaagctggaattccagatattttgtgtgagcagccactgatttttgtctttaccattatacagaggatagttttccctgctacctgtaactgagatgcaaaaaagggccctgtgaatagggactctctcattttaagcagtgtttttgtgttgttttcttcttatttttattgaaaaaatagaaaccatgtgtattagtccattttcattctgctgataaaggcatacctaagactgggcaatttaaaaaagaaagaagtttaattggacttacagttctccgtggctggggaagcctcacaatcatgggggaaggcaaggaagagcaagtcacgtcttacatggatggcagcaggcgaagagagagagcttgtgcaggggaagtcctttttttaaagccatcagatctcatgaaacttattcactaattacaagaacagcagggaaagacttgctcccatgatttagttgcctcccaccaggtccctcccacaacacatgggaattaatcatgagatctgagtggggacacagccaaaccatgaactatgttcaaagcattttcatatacaggcaggcagttctcttctaatgaacacttgacttatgaatgtcccatattcatcaacaacctctcttgagggactttgaactactcttactactcatggaaggtggagttgtttctgctgtctgcagaagtttgtttctccctcaactctcctcttctgggggcttgagttctcacaagctcctattagacccttagaacagttaatacaagagtatcttttcctaatgccaccactaggatgcaggaaggtgctagggcccctgccagaactcccataggagctcagcccatgagggagcacaacaagtatgagggaatctctggaattgtagttggtaatggcggggaggttcttcatctgcatttcaaaatatcttttcctagaaatagcattgtgctgaatagcctacccttgtagaacttgggtgtatgatagattcaccaatctagaccacagccagaaatcaagcagtaaacaaatggtttctaagccactagaaaatatgcatcttacttattggaaaagccgttcaaaaccacactcattgcctgtttattctgtttgtacataagtcttattagttttaactaaatgtcaagcctatagcagattataagcagcaaatctgaaaggactggaaaagatgttacaggtaggtaaagtgaaatctgatagttgatggcaagacaaaagataaaataacattaaaaagaagtttaagcactcaaaaaccaatcacaatgaaacagtacttcacatccaccagaatggtggattgattaaaaatactgacagtaccaaccgttggtgaagatgcagagcactgggaccctttatgttgttggtgggcatttaaaatggtagtcactctggaaaatagtttggcagtttcttacaacaaataccatataacccagaggttctactcctaggtgtttacccaagaaacatgaaaatataggtctacacaaagacttgtacatgaatgttaatattagctttatttataatagccccaaactaggaaaaacccaaatgtctatcaatgggagaattcatagaaaaaatgtgatagagccatacagtgaaatactgctactcagcactaaaaaggaatgaactagtgatacatgcaacaacatgaatgaatctcactgacagtatgttgagtgaaaattcatattcattcatacatatgaaaaattgtaatggatgattgtaatctagaacaggaaaaattagctattgtgatagaaatcagaacagtagttgtctcagggtcaggggtactggagaatgactgaagggcacaagagaaaattttagggggtgatggaaatcttgatttgtcttgagtttggtggtagttacaaaagcgtgtatatttatcaaatctcttcaacccgtatgcttaaaatttgtgcattttattgcatctaaattatatatcaaatttttataaagtacaaaaatttcaaaagggaaaaaatccttcagaagatccccctgctgcaggatctaagtctaaattcctcaacatgatctggctcttacttaatactccttggcttatttctcaccattccctctcacctcctaccacttattctaagctacttatagttccaaaagttgttattctttctttttcctctgaacctttaagcacagcactcctttttcctggaattccttttccattttccatttatcactaaatcattgacatcctttaggactcacagaagtagcacacctcctccaagacgacttgttcactttcaggttgtgttagatgcttcccctcttgctcccagagaacttgaagctcctctccatcaaagcatgtattgctctataatgtaattgtaataattaaaaaaccctcaaacccatagtggactgaggtcatttaatgtacaggcaaatagtcctccacatattcagtaagccctgaattaaatcacatattataaactaatttcttttttattgcattatactaggccctatcatatactttaatattcataaacactgaagtaaatattgctattacggggtttttttagtttttaagttcacaggtacatgtgcagaatgtacaagtttgttacatacataactgtgtatcctgggcgtttgttatacaaattatttcatcacccaggtattaagcctagtatccatttgttatttttcctgatcctctccatcctcccaccttccaccctccaataggctccagtgtgtgttgtccccaccatgtgtccatgtgttcccatcatttagctcccacttacaagtgaaaacataccatatttggttttctgttcctgcattagtttgctaaggataatggcctccagctccatctatgtcactgcaaaggacatgatctcgttcttttttaatggctgcatagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaaacatttattaagtgcatgctacatgctaagtactgttctaactctgcaactgttttatctgcaaagtactattattatccctacttactgatgaggaaactaaagtttaagtaacttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaattcaaggttttctttctttctttctttctttctttctttctttctttctctttctctttctctttctctttctttcttctttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctcaaaaaaaaaaaaacaaaaaaaaaaaaccactaccttttcaagtgtgcttcatcatcttatatactgtccaccacagacccaaggtcatagactatttctgcagcctaacctaccaatcagtcctttaacatagaactaactatacaaggatcctccctcctccaactccagataccttcagtcctttctcagtatgtctgagagccatgatagcatttgtatctctcaaaatcaccctctataagggcctcatctctcccggagatgtcccacacctattaaggtcaacaggaggatttggttctattcttggaattgacagtgttgtaccctgctagcacttacatgatgtgttaattccaatgataattttatcaatgttggtatccactaccatgcccaaatctgaactagaccttctagaactagtttataagtttcttgtgggcagagatttcatttctctttgtataagcctagaatctagcctactatctggaacattgttggtgattgttatgtaagtcgatgatgttgactgccccttcagctaggcagtgatgtatcaatggaaaccatccctgttctgggtgtaatagctttgagttaactagcaatgcattctgtggggcataacaaaatgttgagctagctcctgggcagggtctttgaattgctctgatatttcagcatcactctgtcaattgacataatgctacccctttgggcacaggggtttgtagaatacatagctctgggctgctgcaaaggcatctggattcaaagacagcatgtgtctggctacatctgccaataatatgtgtctggagggttacaaagcaatatgactttatacagatgaaaatgaaaattttaaactgacatttgttgatgtgagtaagggccactgatggaagcagttttagagggcggaagctattaaagagatggagccaggactttgtcagtaggggcaataagaagtataactggctgaaatctgagaaagagctcagaacaaggaccccataataataccaaaaaaaaaaaaaaaaagagccagagcagtaagatagggttttctagtcagtggaggtggcagcagcattgagcctttgaatggagaactggaccagtggggccattctctagagaagtcattttgcatacaattgatgaccaattcaagcctaagaaatgcagtccatgtagtaaaagttacccattattcacctactacttgtagccagtttcccagaagtcttctggctatgtggaagcagggagctaagaagcatggaccctttcctctcctaatcatctcaccctctgatacatgtaagtctctccaccttcagcttttcccctgaggctactcccacaaccatcaaacttttcataatccctggttgcaaaggaagagaggagacaggtggtaagagcaatatcaccttctatagtgggcgtggtcttccctccctctctgagtggtaagtctaatggcttctaaggtttacctcttcatctaacctccgaagttttctcttaaagaaaataatttcctcctttccctaaaactactttatccaaattcagctaccaacgtctctgataccgatcttccttagaatgtttattctgtcctaatacaaaacagttttctctctggtcaaggtcaaagcctctcattaatttttagcacttcttatatacttccctcctgatctgatactctagtcagtcactagactctagtctcttggtgccaatgccaagtttctcatgcagtccaggcatttttctttaatcagtatagcttggaggaatccaagagtcccttagagttaggagtatagaatgcctgggggtccttgaattttattagatttccaacttttcacctggtggtctgtagaaccatttctttagatgtggcagatgctccaatgagttaaagagtggtaagtcaatccaaatctccttttcctttgaaccattcttgttactctgatgagcgtatactatatttattcaatacactcatcaaatatttactaagtaaatacagcagtttatatagtacttgaataaacatt

SEQ ID NO: 1083 - DNA, 423463 bp, mus musculus
tgggcgtcccggcagccgcttgagggatggggcggggtcggccgggacctcctccttcattccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaaatgttggccaatactttttggcattcaggatggacagagccatttttatagactgaggattagcagaacagctgtactgtaaggtttctgtgatggcatgaaactcttacaggtgtataatggcatttagttacctaccctttgtgtggcactaaaatagttctgtctagatttaaacacagcttcctatcttctgtcttttattctttctgttttaatatttttgagcaatagaagcaaggatactagctctttacatttgttgacatcaattggaatcagtttcctagagttatgaagggcttatatgagtccatttcgtttgattcccttgggaaacataggccctaaagggaaagtgacttgcccaaggtcacataactagagtcaaaactgggatgatagttgctctaactcctagttgggtgcccattcccccaactacctcctgggaccttttgcgagggagcaagatggagctccacattagaacttttgcaaagtagagggctcagctctgcatcattttgttctactctgcctgtattttgaccacagtaagtttaaccgtgtgttccttattcttcctgaacttcactttcagatttggagtatactttgaaggaattttagcccaaattcaacttgtttattttaagttgttcaacttaagtttatcttatcttgtatattagttttagtatacaaaaataactttttaaaaaagttgattgggtattaaattaatactgctacaagcttggttaaaatttctagtgccctggtgcaccctctgctggctttacagtgacatttaattttcagtatctgctgacactcagaattctacattgtgctgacagattctgattcagtaaataaggaagtaaacagccttgtgggatttggccacgtaggtcatatttttatattttagtttttaaacacaaacaactgctgttacagcaaatcttggatggagaggaagaaagataaaaatatacacccttcaacgggcagtacattcaggtttcttaccagtttatctgtaaggagtgaaggcaagctgatgagagtaaactgcaggaagctctcatgagaccaagtgggcagaacagtcagagacacttcatgcaggtaggcaaaagtaaacctatccatacttatgagatgatgggctctgggctctcagttatgactcaagaaagggacctggaaatcactgtagatgtatgtatatcatctgtcaatttaaaaactttttaagcagggcacacaaggaagttagggcaggtaggatacagagcagagagatcagcacagttctccatgtgaaatgttagaaaagtctccctggtggggacacacttgctgatgatgaagtgagagagtcacatcagaccttccgtaatcaatcatctccttcagctggagcaaccaagtagctgagatttgtctggatagttggtggagattatctcaagagcaagggatatctcatttgtgtctgaattaggacaatatacagtaatatgatcgtcagagtaaaaaactaaaaatcactgttgatcattctgtggagatgttgcgccggttgtgattgtggtcctcaaaggccaagaatgtagtgggtatcatcaggaagggtgtcaaaaacaacaaaacaaaccacttacaaaacacttattttttccatgtacaagatcaaaagcagattggcttctacaatcagacaggaaattctggtggctgctcctcaagaaaagcctaacagctgataaaagtcctcaaaaaccccattaaattgatcaaaaggatgaagggattttctagttggtttttcagtctggatagaaagaggttgaaggaggaatatgatcaaagtctaccaaaccatgagcgagatgaatatgattaatatattggtgtaacgtaacaatccagttcaataaatagaaagcctgctgtgccagacacaatgttaagtattagacaccttttaatgtttgaaaaattattttcaagaggaggcaaataaaggtagtatcttattcaactcattgtctcaagtaatagtcaaaattatgggtagatcaatacagatttacttagaactgttagggctatttggagtatgttcctaattatttgaagtgatgtcatagatgtcaaccttaaagttctacaaaacattgcttgacataactagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatgtgggtaaatataaacaaacattggctttataaaacaataataatgtctaatttgtaagttaaagaaaaactatatagaaagaaaataccagacaataacatgatacaaaccagcaggggatgatccaagttcaggaaaagattgttcatgaatatactaaccttaaaacttaaatatacatgctgtaaattctagggtgaacaataaaatagtagaaatagagtagatagctttcaaagtaataggagtgaaggggatcctcaatccataacagtggggaaaaaggaatatgaaaagaaatatagaaaaagtgggagaaatacaaagcacaaaatgagctggtatgtatataatcacagtagatgtaaatggactaaattctctggttaaaagacaaaaattatcacacttacaaaataaatttaggcatatgctctctataagacactcatctaaagcataagaacacaggaagattaaaacccaaagaataaaagacaaatactaacaaaaaactgagatactacattactatcagacaaaatagaacttaaggcaaaaagaataaagtaggtttctacttaaacatggtaaattaaccacgtttctgtcatttagtaggagtttgtgagatatttgagataaaaatgataagaatccatgaggacaaagagaacaggagaagaaacttcaattcatgagacagtttaatacatattgaagagaataggtagaagatagatgacagcaagtattagttatctacggctgcataacaaattactccaaaacttagtggcttaaaataacagtacttatctcacaccattcctgagagttaggaatctggaagtaatttacttggggattcctggctcaaaatttttcatgaggttgctgttaggaagactacagtcatctgaagatttgactggggctagaggatatgcttccaaaatggctcactcacatggctattcgcaggagtcctcagttctccaccacatgggcctctccacaggttgcttgagtaccattatgacatgttacctggcttcctccagagcaagtgatccaaaagataaatgatgaagacacagtagtaccttttatgatttagtctccaaagttgcataccatcatttctgctttattctgttcattagaagcaaggcattaagtccagctcacattcaagagggaaattaggttttatttattgaaggaaggaatatttttaaaaagttgtgaacatacatattttcttgagacagagtctcactttgtcacccatgctggagtgcagtggcatgatcatggctcactgcagtctcaacctcctgggctcaagtgatcctactgcttcagcctccccagtagctaggactacagtcatgtgccaccatacccagctattttattttatttttttgtagaatcaggatctctctatgttgcccagtctagtcaaacttctggcctgagcaaacccctctcctcggcctcccacagtcctgtgattacaggtatgagccactgtgcctggccaagaacatattttaaaacaaccactgagtggcaactgagtgaagtagagtaactacaacacaaatgcctgcataatgtggtacttactagaaggagccaattggccctgtataacccctgagagatttgtaacttttaagcactgaatccaacaagaagccagggaaatatgcagggctgaaaacaatagccttgactaaaaatccatgtaggaaatagttggactctcagatcccctcactctaacacacaccacaacagcaccaccactaggaaagaaaatagatttttattttctgaaaaaaaaaaaaaatagatgaatatctctatggtaaaattaatagatggtaaaccaggggatactgtcctgccctcaaattggtacccagtgaattgtgtgcctccatcctctctcttgcctctcctgcacagtaaggaaatacaggattcttaagaaattaaatggccagagaaaggacctccagatactgatatttgagactcccctaaacaaataatcaccttgccttcaatgaccctaccatatggtctacccattgacaagctccaatcatgtgcacacaactttcagtcagttttttattgattcattttttaacatgaacatgtaggcaaggattactacatagctgaggaagcctcaaacattaaagatagggtaaacaacagccaaacagaaaagaagaacttgaaaaaaatagacaataaagcaaacagaagaaaagtgtatatatatatatacatatatatgtatatatatgtgtgtgtatatatatatatacatatatgtatatatatgtgtgtatatatgtgtgtgtatatatacatatatgtatatatatgtgtgtatatatgtgtgtatttatgtgtgtgtgtatatatgtatttacacatatacatatgtatgtatatgtatgtatgtgcatctacaggtgtatgtatgtgtgggcatatatgtatatacatacatatgtgtatgtatatgtgtgtgtgtgtatatatattctgtgcaaagtgagagagggaatagttgtgtactagcttaaatattgcaccattttgtattttgagatggttgaaatggaaccaagcactaaaatttgaaacgatcttatacacatgcaaaaactggcagcttttcacatgtagcattatattgacattttacttgacttcctaagccactagtgaattaacctggcttctttgtattcattattttaaagaatgtattcatttgtttttacatactaatgttagaagtaggtgctggggtagagctaacttaattgctctctctctctctcagtgttgttattcttttttaaaatgtttgttttatagaagtataatttacatacagcaaatgttgccttttaaatttttaattttaaaattgtactattctgacacaaccaaggaccctcacagagtccacttcactcccctgctaactccactggagcaggtgctggtactcacagctgcaagaactgaagatggatcacacctgaaaattgatgcactctttgcagacactccctagtaccagcccagagcccattagctccactgggtggctggacccagaagagaaataacagccactacagttcagctctcaggaagccccattcctaggggacagggagaacaccacatcaagggagcacctcgtaggacaaaagaatctgaaccatagcccttgaatcccagatcttccctctgacatagtctacccaaatgagaaggaaccagaaaaacaattctggtaataggacaaaacaatgttctttaacacccccagaagatcataccagctcacaagcagtggatccaaaccaagatgaaatctctgaattgccagaaaaataattcagaaggtcaattattaagctaatcaaggaggcaccagaaaaaagtgaagtccaacttaaatcaaaaacatggccaggcacagtggctcatgcctgtaatcccagcactgtgggaggctgaggcgggtggatcacttgaggtcaggagttcaagaacagcctggccaacatggtgaaatcccacctctactaaaattacaaaaattagccaggcatggtagtgcatgcctgtaataccagctactcgggaggctgaggtatgagaactgcttgaacctgggaggtggaggttgcagtgagtcgagatcgccactgcactccagcctgggtgacagagcgagactccatcttgaaataaaaaacatgatacaggatatgaaagaaaaattattcagtgaaatagatagcataaataaaaaacaatcacaacttctggaaatcaaggacacagagaaatgcaaaatgcactggaaagtctcagcaatagaatcaaacaagcataaaaaagaacttcagagcttgaagacaaggctttcaaattaacccactccatcaaagacaaagaaaaaagaatttaaaaaatgaataaagcctctgtattagtcagggttttcttagacagaactaatagggtatatatataaagtttatacttaataaactcccatatatatacatacatatatatgtatatatagtgggatcacaaggtcccacaataggttatttgcaagctgaggagcaagaagagccagtccgagtcccaaaactgaagaacttggagcccaatgtttgaggacaggaagcatccagcacgagagaaagatgtagactgggaggctacgcctgtctcttcttttcacattttcctgcctgctttatattcactggaagctgattagatcgtgcccaccagattaagggtggatttgccttccccagcccactgactcaattgttaatctcttttggcaacacccacacagacacacccaagattaatcctttgtatccctcaatccaatcaagttgacacttagtattaaccatcacaagtccaccccttgtcaacttgaacccatacacatctcctgagatcattcataatcttcaaataaagacaatgaggtcataattacacctaacataatacaactgtccttcgtacaactggaattgcaccaatccccaactcaaatactattaaataaagttaacacttaaatgctgatacgaagtcagtaagtcttacgtcacatgataaaggaaaaggaaataagatgaagatattttcttagtacaagtatataaatgcaccaacatgtttttaacaaaagaagtaggaaatattcatgacagttacagtccccgtttctgcagctggtcatgtggtcgtagctggtattgatgactaccttcttctactacccattctgtattctctttgccttcagcgagcacctcagcaggtcatggcttttttcctggtggagtgactcaaaccttcattcctggagggtctgggtcattcatagtcctgcctggattgggctgttgtagtttcccattgaccttaatcacaaggtatggtaatgctaagagacgccctaatggatctcctgtattccatgcatactcttccttaccatccttgtggagtagtagacttatttcatgttgatagcctgggtcaaccaccccagccaacactgtaactccccttttaccctgttgacttaagattaggaggagcctaaagtgtccaggtggcaatcttaacttccagtttaatggaatcattgttatgtctcctggtggcagcgttcttccctctagaactaagatctctaggccagcagaacgtaatgttgcgggaacaggaggcaaaaattttgctagtggatcactaggggtgatggtaagtggtgccacttccacttccatctcttgattcctggacctgtgaattctggctatgggagaaatagtaccatatattggatgctgattcagagcatacacggccttatggagaactttgccccagcctggcacagtgttgtcacctaattggcattgtaatcgtgacttcaaaaggccattccaccgttctgtcaatccagctgcttcaggatgatgggaaacatggtaagaccagtgaattccatgagcatgagcctactgcctgccgcacttctttagccataaagtgagtgcctcggttagaggcaatgctgtgtggaatactgtgatggtggataaggcattccgttagtccacggttggtagtcttggcagaagcattgtgtggaggataggtaaacccatatctggagtaagtgcctattccagtgaggacaaacctctgccctttccataatggaagaggtccaatataatcaacctgccaccaggtggctagctgatcaccccaaagaatggtgctatatcgagggctcagtgttggtctctgctgctgttaaattgagcactcagcagtggctgtagccaggtcagccttggtggatggaagtccatgttgctgaacccatgcataacctccatccctgccaccatggccactttgttcatgggcccattgggtgatgacaggggtggctgggaaaagaggctgagtggtgtacacagaatgagtcatcctattcacttgattattaaactcctcctccactgaggtcacctgttggtgagcattcacatgggatacaaatatcttcatagtttttgaccactcagagaggttcattcgcctacctcttccccaaatttctttgtcaccaattttccaatcatgcttcttccaagtccctgaccatccagccaaaccattagctacagcccacaaatcagtgtataatcgcacatctggccatttctccttcatgcaaagtgcacaactagcattgctcgaagttctacccactgggatgatttcccttcaccactgtccttcagggatgtcctagaaaggagctgtagtgctctagcttccactttcaggtggtgcctgcatatcatgcagaaccatctgtgaacaggctgtaatcttctcttcctctgtcaactgatcatagggaactcctcatgaggccattggtgcaggctgggggagagaaggtagggtggcaggagtggagaccatgggcatttgagccacttcctcatgtaacttacttgtgccttcaggagctgcttgagcccaatcacgtatataccacttccatttaatgatggaatgctgctgtgcatgacccactttatggctagatgggtcagaaagcacccagttcatgataggcagttcaggtctcatggtgacttgataacccatagtcaaactggaaaagcccagtctctctggccaagagctgtctctcaaaaggagagtagttatctgcagaagatggcagggccttgctccaaaatcctagaggcctccattgtgattcacctgtgagagcccgccaaaggctccaaacagcatccctaccagccactgacacttcaagcaccattgaatctgctgggtcatatggtccaagtggcagagcagcttgcacagcagcctagacctgttgcagaatcttctcctgttctgaacttcactcaaaactggcagcctttcaggtcacttgataaataggccagtgtaatacactcaaatgaggaatgtgttgcctccaaaatccaaataagaccactaggcattgtgcctctttcatggttgtaggaggggccaaatgcagcaacttatcctttgccttagaaggaatatcttgacaggccccacaccactggacccctagaaattttactgaggtagaaggttcctgagttttagttgaatatatttcccatcctctggcatgcaaatgtctcaccagtaagtccatggtgtttgctacttcttgctcactggttcgaatcagcaaaatgtcatcaatgtaatggaccagtatgatatcttgcagaagagaaaagcgatcagggtctctccaaataagattatgacacaaagccagagaggtaatatactcctgaggtaggatagtaaagtatattgccggccttgccagctgaaggcaaattgcttctggtgggccttatggacaggaatggaaaaaagggcatttgccaagtcaatggctgcataccaggtaccggtagatgtgttaatttgctcgagcaatgaaaccacatctggtacaacagctgcaattggagttaccacttggttaagcttatgataatccactgtcattctgcaagatccatctgtcttctgcacaggccaaatgggagagttgaatggggatgtggtgggaatcaccacccctgtgtctttcaagaccttgatggtggcactaatctctgcaatcccgccactgatgcaatattgtttttgatttactattcgtctaggtagaggcagctctaatggcttccatttggcctttctcaccatagtagccctcaccttactagtcagggagccaatgtgagggttctgccagctgctaagtatgtctatgccaattatgcattctggcactgaggaaatgaccacaggatgagtctggggacccactggacccactgtaagtctgacctgagctaaaactccattgattacctgacctccataagcccctacttgacgttttgggtcccctggaatcaaggtcagctcagagccagtgtccagtagtccccaaaatatctgatcatttccctttccccagtgcacagttaccctggtaaaaggccggaggtctccttggggaaggagaggagaaagattcactgcataaattgtcagtaatatagtggggtccttcctcaaggggacccagcctccccttcattcaaggggttctgggtctgtaaacgggctcaagtctggaaattgattgaggggctgtgattcaaattagttttttgtccatttgacctagaagttttctgtttgtgtaatttaagtaggaatgcagtaggcttcctatcaatttcacttctaggaacaccatgattaattagccaatgtcagagctctccactagtcagactattctgattgttgctttgcctctgctgtccattatggtagccatgcccaccttgcctttcatggttgagtgctgtcacgtggccgctgccacctcaggatccaattattcccattgtatttgaattttgtagttgagtgactatggttcccaccattagatctgacatacagagaagagcaattacagggctattcaaagatgcaggtgctgccctcacaaatctattttgcaaggcatcagtcaagggtatagcttctggaccctcccagctgggatgagtaagtctaaagtaactaatccactccaccatcccaatctccctaagcctttggatcccttcctctacattaaaccaagaaagatcaggcatttccagctcactcatggtgggccatcttttaatccatatttcagctaaccaagcaaataaactattataaccttttttaactccctgagctgcaacattaaaagcagagtccctacttagtgggcccaaatcaataaattcagcctgatccaactctatgtttcttccaccgttatctgatacccttaatatctattcccatgcttgttctccaggtttctgtttatattaattagagaactcaaacagttcttttccagtgtagtgcacctcctcatgggtcacactctcaaacttacctctaggggcccgccgggagtttagtctagttataggtctagaggcaaacagagatgttgggggtggtttctgaggagaatcaacattatcttgcctggcaactgcctcaggggaggccattactgttgcctcaggcagtgcagggtttatctcctcaaaggtggacaagctgatggcagcataggtcagggaggggacgttgccactactagggatggggaaactgttccttcttgcaaaaaaggttcatcagagtttgcaaactcagtgtgcccagcttcatcagggtcctcccacgcatccccattccaggttgcagggtcccattttttttccaatcaatgccctcattttaacagtagatacttggcaaggctgtgcatgcatctttcattgtaggtcaaccactcgtatagtaagagcttgtgtctgtttttccacagtttcagctctttctctgcaggagataagactctcactcagggcaatcttagcagatttgcggctcagtatctgcttctgaagtcaggtgacagaatccctgagttcattttctttcatcactttttccactgaacttaggagcaaccaaccagcttcattatgttccttggttctccacatatggtcaaaggtattatgtatagagtcattgagctccttgcctctcatgagtggtgaatcagaagtgtcaaatgcatttattttgcataactctctaaacagtttctgccaaggactattaatgttctccatactattagaagtagagtccttagcatttttgagtctaatcatattaagcagccaactccagaaaccccaaaaccaacaaaagaactccatgcttaatattctgtttctctagaaacactcctggtactaaaatctgtattagttatggttctttcagagggacagaactaacagtatgcatatataaaggggaatttattgagtattaacttatacaatcccaaggtcccacaataggctgtctgcaaactgaggagtaaggagagccagcctgagtcccaaaacggaagaacttggaacttggagtccagtgttcgagggcaggaagcatccagcatgagaggaagatgtagactaggaggctaggcccgtctctccttttcacatttttctgcctgctttatattcactggaagctgattagattgcccactggattaagggtggatctgccttccccagcatactgactgaaatattaatctcttttggcaacacccacacagacacacccaggattaatactttgtatccctcaatccaaccaagttggcactcagtattaaccatcacatcttccaagaactttgggactatgttaaacatccaaacctaagaataactggctttctgaggaagaagagaaacctaaaagtttggaaaagatatttgaggaaataattgaggaaaacttccctggccttgctagagagctagacatccaaatacaagaagctcaaagaacacctgggaaattcatcacaaaaagatcatcacctaggtacatagtcatcaggttatctaaagtcaagacataggaaggaatcttaggagctgtgagacaaaaacatcaggaaacttataaaggaaaacctatcagattaacagcagatgtctcaacagaaaccctacaaggtagaggggattggggtcctgtttttagcctccttaaacaaaacaattatcaatgaagaattttgtatctagtgaaactaagcttcataaatgaaggaaagatacaatcttttccagacaaacaaatgctgagagaatttgccataaccaagctggcactacaagaactgctaaaaggagctctaaatcttgaaacaaattctcaaaatacaccaaaatagaacctccttaaagcataaatctcacaggacctatataacaataacacaaacaaaaaaacaaagtattcaagcaacaaatagcatgatgtatagaatagtacctcacatctcaatactaactttgaatgtgaatggcctaaatcctccacttaaaagatatagaatggcagaatggataagaattcaccaaccaagtttctactgtcttcaggagactcgcctaacacataaggactcacatgaacttagataaaggggtgggaaaagataatccatgcaaatggacaccaaaagcaagctggagtagctatactaataacagacaaaacaaactttagagcaacagcagtttaaaaagacagagcaacattatattaatgatagaaggactagtccaacaggaaaatatcacaattgtaaatatatatgcacctaacactggagctccaaaatttataaaacaattactactagacctgagaaatgagatacacagcaacataataatagcgagggactttaataccctactgacagcactagacaggtcatcaagacagaaagtcaacaaagaaacaatggacttaaaatatgccctacacaaatagacttaacagatatatacagaacattctacccaacaactgcaaaatatatattctattcctcagcacatggaacattctccaagatagaccatatgataggccaaaaaaaactcaacaaacttaagaaaattgaaattatagcaagtactttctcagaccatagtggaataaaattggaaagcaactccaaaagcaaccctcaaaaccatgcaaatacatggaaattaagtaacctgctcctgagtgatcattgggttaagaacgaaattaaaatggaaatttaaaaattctttgcactaaacaataatagtgacacaacctatcaaaacccctgggatagatcaaaagcagtgctaagaggaaagttcataacattaaatgcctacatcaaaaagtctgaaagaatacaaatagacaatctaaggtcacacctcacagaactggagaaacaagaacaatccaaacccaaatccagcaaaagaaaagaaataacaaagattagagcagaactaaatgaaattgaaacaaacaaaaaaaatacaaaagataaatgaaacaaaaagctggttctttgaaaacataaataaaattgatagaccattagtgagattaatcaagaagagagaagatccaaagaagctcaattagaaatgaaatgggaaatattacaactgataccacagaaatacaaaatatcattcaaggctactatgaacacctttatgtgcataaactagaaaacctagaggagatggataaattctaagagagaattgaaatgataatttaaaaattgccaacaagcaaagaatccgggatcataaagattcacagctgaattctatcagacagtcaaagaagaattggtactaatcctatggaaactattccaaaagatagagaaagagggaatcctctctgaatgattctatgaagccagtatcaccctaatgccaaagccagcaaaggacataacaaaacaagaaaactacagaccaatatccctgatagatgcaaaaatcctcaacaaaatactagcaaaccgaatccaacagaatatcaaaaagataatccatcatgctcaaggtggtttcatacaagggttgcagggatggtttaacatatgtaagtcgctgggcacggtagctcacgcctgtaatcccaacactttgggaggccgaggcaggcggatcacctgaggtcggaagttcaagaccagcctgaccaacatggagaaaccccatctctactaaaaatacaaaaagttagctggacgtggtgacacatgcctgtaatcccagctactcaggaggctgaggcaggagaatcacgtgaacccgggaggcagaggttgtggtgacctgagattgtgccattgcactccagcctgggcaaaaagagcgaaactctgcctcaagaagaaaaaaaaaggaaaagaaaaaaaagtaagtcaattaatgtgatacaccacataaacagaattaaaaacaaaaatcacacgatcatctcaatagatgcagaaaaagcatttgacaaaatccatcatccctttatgtttaaaaccctcagcaaaatcagcatacaagggacataccttaagataataaaggctatctatgacatacccacagccaacattatactgaatggggaaaagttgaaagtgttcttcctgagaactgaaacaagacgaggatgcccactttcaccatttctattcaacatagtactggaagtcctagccagagcaatcagacaagagaaagaaagaaagggcatccagattcgtagagaggatgtcactgtttactgattatatggtcatatacctagaaaaccctaaagactcatccaaaaacctcctagaactggtaaattaattcagcaaagtttcagaatacaaaattaatgtacacaaatcagtaggtctgctatacaccaacagcagccaagctgagaatctaatcaagaactcaacccctttcacaatagctgcaaaaaaataaaatacttaggaatataactaaccaagcaaatgaaagacctctatgaggaaaactacaaaacactgctgaatgaaacaataaatggcacaaacaaatggtaacacattccatgctcatggatgggtagaattaatattacgaaaataaccatactgccaaaagcaatctacaagttcaattctcatcacaataccatcatcattcttcatataactagaaaaaacaatcctaaaattcatatggaagcaaaaaagagcccacacagccaaagcaagatgaagcaaaaagaacaaatctggaggcctcacaatacctgactttgaactatactataaggctatagtcaccaaaacagcatggtgctgatataaaaataggcacatagatcagcagaacagaatagagaacctagaaataaagtcaaacacttagagccaactgatcttcaacaaagcaaacaaaaacataaagtggggaaagaacaccctattcaacaaatgctgctgggataattggcaggccacatgcaggagaatgaaactggatcctcatctctcactttatacaaaaaatcaactcaagatggatcaaggacttagaaatctaagacctgaaactataaaaattctagaagataacatcagaaaaacccttctagacattggcttaggcaaatttacttcatgaccaaaaacctaaaagcaaatgcaacaaaaacaaagataaataagtgggacttaattaactaaagagcttttgcatggcaaaaagaacagtcagcagagtaaacagacaacccacagagaggaagaaaatctttacaaactatgcatctgacaaaggactaatatccagaatctataaagaactcaaacacatcagccccccaaaaaaccaaagaatcccatcaaaacataggctaaggacatgaatagacagttctcaaaagaagatatatataaacagccaacaaacatatgaaaaatgctcaacatcacaaattatcaggaaaatgcaaaccaaaaccacgtgataccaccttactgctacaaaaatggccataatcaaaaaatcaaaaaataagagatattggcatggacatggtgaaaagggaacacttttgcactgctggtgggaatgtaaactagcacaaccgctatgaaatacagtgtggggactccttaaagaactaaaagtagatctaccatttgatccagcaatcccactactatgtatctacccagaggaaaataagtcattaagcaaaaaagatgcctgcacacgcatgtttatagcaacacaatttgcagttccaaaaatatggaaccagcccaaatgcccatcagttaacgagtggataaagaaactgtggcatatatatatatatggtgaggtataaaggattacacattgagtacaatgtacactgctcaggtgatgagtgcacaaaaatcttagaaatcaccattgaagaatttaataataagaataaaatataagaataaaataaaagaataaaataaaaataatacaataaaaaataataaaaaaagaataaaaataagaaatgtttaaaaattatactattctgagagtttgggcaaatacatacagccatgtaaccatcacttcaatcatcatgtaaaaccattgatcatcttcctaattatcccagagatctttttatagtcaacccttacccctgccctcagctcttggtaactacttgtctgtttcctttccctatagttttgccttttctagaacatcctaaaaatgcaaccatggaatatgtaggtttttgcatctggccttttttcatttagcacaatgcatttgaggtttatctgtgctgttgtacattagctttctatgccttttcgttgcttaataagattacattttatggacatgatatagtttatccattcacaggttgaaggacatttagattgtttccagtttttatgattatgaataaaactgttataaacatttatttatggggttttgtataaacataacatcatttctcttttttaaatatataggagtagcactactgggttgtatgaagaatgtgtatttaactttagaagaaaatgccaaactgttttgcaaaatgaccataccactagacccagcagggtggctcctgcctataatcccagcactttgggaggccaaggtgggaggatggcttgaggccaggagtctgagaccagcctgagcccatctctgtgaatatatattttttaaattagccaggcatgatggtacacacctgtagtcccagctacttagaaggctgaggcaggacaacttgagtccaggagttggaggctgcagtgaactatgatcataccactgtattccagcctaggcgacagagaccctgagtaaaaaaaatgaccataccattttgcatacccttgagcaatatatgagagttcctgttaccatctcttcgtactgttcatttttaaaattattatctcagacatcctaataagcatatagcaaaattccattgaaatttagatttctttaatgattaataaagttgaatatcttttataatgtagtaaagtgtcagtttaaacctgttacccattttttcttttttttgtttttttattatgacttttgagagtcctttatattttttgtatagaagttctttataagacatgtgatttgtaaatattttttctcagtctgtgagttgtcttattgctttcttaccagtgtctttcacacagcagaaattttgaagtccaatttatcaagtttgttctattatagattgtgcttttggtgtcatatctaagaaatctctcccaaacccaaggttacagagattttctcttatttttccttctggatattttataggtattacatttatatctttgatttattttgggttaatttttgtatatggtgcaaagcatgagctgaggttcatcttttttgcatatagataacagttgttcaagcaccatttgttgagactattctttccctattgaattactttgacatctttgtcaaaaagcaattgaccatatatgtgtaggtctatttctggatgctctctttgttcccttgatctatgtgttcattctgttgccagtaacacagacttgattctctcctctaactttgttctttttctttttctttttttttgaaaagatacagttttattaaacaaacctggaatcaacagtatattacataaattagacagcagtaaaattttcctagggcatatgtacaaatcacagtgatttccattgtgcaacagacaggattaaaaataggcactcccctccccgaccccccatgagaaggcggggtcacccccgcagggttcccagttctggctcgccaaggggtgcacaaacctgcaaaggcactttgcttgtgtgcgcggcaacaggggccccagaagcacgttggcaacatggtgaggctgcccagtgttcagcgcaaaaaaataattcagctatggcagctgagcagagctcaacagccatctcagaggacaaggactgtggaaaagcttcaaatctcatccgctaaaacacaattgcaatgccatttacatgcagaacagacgtctccaccatggaagatcaaactaagcctgaacagaacttcccaacacatgataatttacagaaaaccatgacagagcatccctgctattaggaaggactgttctgcggggtgcaaggccataaggtttgcaaagcaaacttgattatgaaaaggcttggtgaaaatacagcccctcaccttcaccaagacacacacacacacacacacacacacacacacaccgcaaagaaactatccaaatgcattaagacacctgttcgtgtgcttttcttcttgcttttgttaagtgaatcccatccgtttaagttagactaattagaaggccttcttgcctccgtcggcaacagagaaaaacagtgcatacgactcctccaatgtgtgtaaaatgcatgctaggtagattgaaggaaaaatgagaggaacccgggcaccccacttcaaatctcatgtttgctgactataaaaataaatcatagtaatattattgaacattctactttgttctttttcaaaactgctttggccattctcgttctttgattccgcgccgccccctccccgcccccaaccgctcccgccaagccttcaaggtactgttcagctcttagtggctagtctggaacctgcactgtggactactgcttagttccgttctcgaagtctttcatattgctgtttaggatctgatccttgcatttgcaacttggggatgagcccagggatttataagcaactttatggaattgctttcctgatcttctccctctctacagtctctcagtcctttcctattccttgttgctgttctttttggttcttcagccatagtgatagggctttagttacctgtttctgtcacatactcatcactactttatctgcgtccagggccaagtggctgtaagaaagaaagaaaaaatataatggtgatcaactcaccctcttgagacctcagctcctccaacaggagagaaagttcgccttccctcagttttaggcaactacagcatccctgctaatgctgatgctgccattaatgctgctgcctctataatggaaatgcttataactaggtcatgagagtatggaaaaaggaaccaaaaaaacacacagagtgtttaccccactgtttcctcctcaaaacagaacaagaaatactgctgtttctttaagaggaaaaggaagatggcatacctgggctggagaaaaattttctccacctacccgttgtttctagcagtatggcttcctcttcctctgtgcctgtgtagcctccatccccagctgaacatgggtgcaggttcctccttccctgcctcctgtgaagtttcactataggccacaaactgtgaaaaatctaaagtcaactctccccatgtgttggtattcttactttcttggcaagcaaattctgttctccaaaacagtagtagtaggacaacaagttgttcttagcaaaggaaaaaaatcactttattgttattttagtttttttaaaaaaccaataaagtggcatattgtatctgattatattgggaggtttaccatttttttgttctgagggggatgggaccaaccaagccattcacaacgaacatgggttcagaggagtttctaaatggaaagagattaatctgtagcacccagaagataagccaaactatgtcattttgagtgaacagtcaggttggcaaggcaatgtacttgaattttcattcaccttttcagctaccaaagaatgtttctacccgtctcttgacctaatcatcctgcagtttggaaaatcaaactctccaatacatgagatgagccaacagagccagaccatgaccaggagatagctcatcccagagaaggacatgcttaacaacaacaacaaaaaattcaaaacatctatttcctccactgctggggactttcaactagttaggcatgtgacttcctggtgactcaggggacgaaactagtgatgaaacagccaccaccatattgccagtagtggacaaaaagagaaggaaagtgaatctgccttacaactgccagaagaacctcaggatttggcatcatcgggtcagaaaaggaaaatccatgtgttgtccttctaccccagtagctgaattatagcattttggtctcctggtatacctcacattgggcagaaatagctatattagcatggatcatagttactgggctttacctgttcccattgggccttggttagggaatatcacttcgttggcttcaaacatgcttatctcacatacagattgtaatctttcctttcttttgggaaattttcctgtatgcaaaacatagagtggcagggagatgcaatgtcatgccccttctccacaaggactttggatgttggactttgctttcttgccattacctagtggttaaagccccatcattgaaatttacatagtttctcaattggtatttgggcaactctaacttcccatgtagaaactttaacttccttatccctgtatagaaaaatccttgcctttggcaagggggagtggtggcaaagcctgacgcatcctgacacctcataccccacgaagtgccttgcctccacaagaaaaagcaaagccagtgaccagtttggctgcagggccagcccctttgcaactagctttccgacatttttgttttaatttttttttttaaggatagctcttaaggggttgatcctgagaggttgggcagggggcttccttcctaatgcactgttctcactctccaccaccaccccccaaaaaaaacctcttactagatatttggccttcgtaacaaaggtaaagagccccaggtccctttagcatgcagagtaatggggatccctccagggccattggcacttcaaggtggtcccagactcataggagattctgttgtcatctttcttaaataaatttgaatacctcagaagtgatttggtcaccagttcagtcctcaccaacacatcacaggactccctccttagcccagttgccatagttgcttagctatattcctcagccagatccttggaattgatccctcccactggcccctatccactcaaatccatttgctctgtggtttttgagctgtctccatttcaatgctgcattagtccattttgcgttgctataagagacacctgagactgggtaatttgtaaagaaaagaagtttatttggttcatggttctgccaactgtacagacatggcacccacatctgctcggcttctggcaaggcctcaggaagcttttactcatggtggaaggtgaagggagagtaggtgtgtcacatggcaagaaagggagtaagagagagggggtggtgccaggctctttttaacaatcagatcttgtggtaactaatagagcaagaactcactcattaccacaaggacagcatcaagccactcataagggatccacctccatgacccgaacacctcccactaggccctacctccaacattggggatcacatttgaacatgaggtttggaggggatgaacacccaaactatctcaactgctgtgatgcctgaggatctttttctttgggattgatgcaattgttttttcttaatttagcatctgtttattgaaaaaaaaactagccttaatattataccattaggagttctcctaagccatacagtccttccagcattgcattctgagcagattgaggcaagcaggctaggattccatggagttataaagagtcttcccttggtgaacagagcatgactcatgtctatgcagtctaagcatgtaagggttgatcagttgctatacataccttggtgcttcccagaggtctcactccagactgctctgcaaatgtggatagagtacaccagcacccagtgtgcattcatgattgccttaatgaacattctcttgctatttttggtctgtctaggagtaaacagggtctaagaaggtgcaagtcaggtgactaggttagcctccaattgaagttccattttatgaggtccccagtagaagtgttgattgcctgtttagtcacagtgagctttaagtacatagaaacagcccctgtctattaggcagaaacatcatcctctaaagtaacttccaacttacttcagtggaaatatacactggtggcgcatattcagtgtcaattctcagtgtttgtaactacttttttttttttgagacggagtttcactcttgttgcacaggctggagtgcaatggcgctatctcagcttactgcatcctctgcctcctgggttcaagcgattctcctgcctcagcctcccgagtagctgggattacaggcatgcgccaccatgcccagctaattttgtatttttagtagagacggggtttctccatgttggtcaggctggtctcgaactcccaacctcaggtgatccaccccccaatcccttggcctcccaaagtgctgggattacaggcgtgagccactgcacccggccctgtaactacctttaatgccagaaatataaaatgtgatgctgttaagtcaaagcgattactaaagatcgcaagcttaatttttaatgtaaatatataatctgttccccctcctagtgagcaagcatggcctacatttctcaagtataagtactttcatggcagcctataacatatctcctcaaaggaactcgatctttcttctgatgcatgtctttcaagcccaatgcctactgtgtcccaaccacctcttccattttcatatttcagtttttcattcccagtgagttgacctgacaatgttgttttgagtgtcagagccatgttagggccagagtttctcagatcaggaactcgtagtaccatacagccaaattgcctttgccaggccactgccaccattaccaccattgactcaaggtgggcagatgaattctagaaatccttagggagccaggataactgggtacccaatttggattgaccacgtgggcaacaggaatttgtctctaagattcttgcctttattgactccccggtgctgtgggaaagtcctatctatacgttgatggccagtgactcccaatcttccccatgatgggttggcagaaatctaattgggatttctttggttttgtttccttagacttttttaatgggaggtttattttgtttctgaataagaaaaagaaaagaataccatggcccttatgaaggtttatagagttttgagcagtatttcagccataaataagcaatcttagaagtctttgatcaactaagtagtcttaaaaatatgctttttagggggccaggtgtggtggctcatgcctgtaatcccagcattttgggaggcaaagttgggaggatcacttgagcccgggagtttgagatcagccagggtaacatagcaagacattgtctctacaaaaaataaagaagagaaaaattagccaggcgtggtgggaggattgcttgagcctgagaggtcaaggctggagtgagctatgattgcaccactgcattccaggctgggcaatagagcaagaccctatctcaaaaaaaaaagaatttttttctaactactactgaaagtgactgagtgcaaaagagtaggtttctccattgtattcaaaataatgagtaggtcccaaaatatagatagtagtagttgacatatttcctcaaaaagcagccaggaaactcacttcagtatttgtttgtatatcagcttacaaaagaagaagtgaacctatactccatgtatttctagcttaattaccaagtagattaatggttgcctaggggtagagggaaggtggaaatatagaatgactgctaataggcaaggagtctcttgtaggtgatgaaaatgtcataaaattagattgtggtgatggttgcacaacttagtgaatatactaaaaaccaatgaatgatagactttaaatggatgattatgtaagtgaattatatctcaattttttagaaacgaagtaaaagtggaaatgtttctatctttacagatttgcttattctgaacatttcatataaaaggaatcagaatcatataaactctggtcttttgtaattgccttcttttacttaacataacatttttaaggtttatccaggttgtagtgttattctattttattgttgaataatattttgttgtatggatataccacattttctttatccattcatcagttgatggacatttgaattgtttcccccttttggctattgtgaatagtgctgctatgaacattcatgtacaaatttttgtttgaatacctgtcttcaattctttcatgtatatacctatgagtgggatatctgggttatatagttactctatgtttcacttttcaaggaactgccaaactgtcttccaaagtggctgcaacattttacattcttactagcaatgctggaggattccaatttctccacatcattgtcaacatttgctattatctctcttttctattataaccaccctaatggatataaagtggtatctccttgtggttttttacttgcattttcctagtgattaatgatgttaagcatcttttcacgtgctcattggccatttgtacatcttttctagggaaacatctattcatatcttttgcccaatttttaattagttcagttgtctcttttattgtggtaaaatataaataacataaaatttatcattttaaccatttttaaacacatagttctgtggcattaagtacattcccattgttgtgaaaccattaccactgtcatctccaaaacgttatcatcttcccaaactgaaactctttaactattaaacactaactccccattcttcttcccagcccctggcaaccaccattctacattctgtctctaagaatttgactattctaagtacctcatataaatggaatcttacaatattttttatgaatggcttattttacttagcataatgtcttcaaggttcatccatgttgcagcatgaatcagaattttatttctctttaaggctgaatgggagagtgccatcaacaagatcgtgaaacaggatgctgttcatatttctccacagcaacaataattttgcagccatccacagacaaaattgtctttgtaggagccttggaattcaggtacaagtttgtgaaacccctgcagaacccaagacttaggaaggtcattttgacaagaggtacccacatccagataacatacttactaacctttgtttcaactccagacccggaaacagccccatctacctgtgggctcagctacagccccatctagctttggtcctgctaccaaaaccatctgccaagaggcccaggggaattatgcatactactgcctcaggagagaggcctactaacctcagtatcagatgtggaccttgaaataacactgtaacttatctccagcctttcttagtaattgtacaagatcaatcctgctcacataaggatccagagggagacacacttaggtccctggggcaggattaccaacctcactcccacagcaggtgcctaaatggctctgaatcccatcttcagcctcacccagctttggtctgagagcaatccttcccacacagggacacagagggaggcatgctttgctgtgctctgcaggcaagccagtttacctagttcccatagtagatcatgaaacagacctaaaaagtggcatcagcccccctcagctgtagcttgagagcagtcctgcccatgaagagacctgcagggagaaatgaccatcagtgaccttgcaggcggacctgatgttctcagtcccactgtggatcttgaaatggccccgttatttggctccagtgcctctcaactgtagtctgatagcaggactgcccacccagggacccaccaggagaaatgccaatctgtgaccccagaaaaaggctgaagacttcagtttcagcttgtaggccctaaaacagccctgcaacttggttctagcccttctcagctgcagactacagtagtactgcatgccaaggtacccactcagtgatccaacaagagctttcccagggactcaaagtaagtcacacccatccacatacctagtaacaggcctgccatctgtgggccctgaattgggtgctcatcctggcaccagtcctacaaaccaacatcctagagacagtccagtcacccagggaccagacaggatccacagctgctagagcccctgataatagacctgccaactgtggaccccaattgcagacccagcagcagccacattacccagttcaaaccccatttgactgtgattccagaggcattccatcaacccaagaacctaacagaagaaggccttaacttaccaaaatcagtctgcaaagactgaaagaggaatttccttcaaatacatggacatcaatgcaaagctacacaaataaggaagaatcaagcaaatgtgagccaccaaaggaaacaaataaagttccaattactgacggcaagaaatggagatctacaaattacctgacagaattcaaaatgatcttcttaaagaagctcagtgagattcaaggaaacatagatagacaactaaataaaattaatagcctaggcagcatggggagacctcatctctacaaaaataattaactggacatgttggagtgtgccttatagtaccagctacttgggatgctgaggcaggaggattacttgaacccaggaggtaggctgcagtaagccatgatcgcaccactgcactctagcctgggcaacagagtgagactccatctcaaaaaaataataaaaacaaataaataaaattaagaaaataattcatgatcaaagtgagaagtctaataaataggaatcatttaaaaagaactaaatggcgctaaagaatacaatgatagaactgaagacttcaatagagagcttcaacagcagactccatcatacagaagaattagcacacttgaagagagaaaaggaaaagaaagtttatttaaagaaatactgtctgaaaacttcaaatgttgagaagggatatagaccccccagatttatgaagctcaaaagacctcaaatgaaataactcaaagaagaatactccaaggtacattatattcaaattgtcaaaagtcaaagacaaagcatcaagagataagagattcatcacatataagggaaccctcataaggctaccatgagacttctcaacagaaaatcttgcaagccaggagggagtaggatggtatatacaaagtgctgaaagaaaaggaaactaccaactaggaatattatacctggcaaatctgtcttttggaaatgaaggagaaataaagacatttacaagcaaaagctgagggagttcatcaccactgggcctgtcttacaagaaatactaaaagaagttcttagaattgaaacaaaaggatgctaattaacaacatgaaaacacatgaaagtaaaaaactccatggtaaaggtaaatacatagtcaaattcagaatactttgataatgtaatagtggtatataaatcacctgtctctagtataaaagttatctctagtataaatgttaaaagacaagactgttaaaaataactatagctataacattttgttaaaggatacacaatataaagagatgaattatgacatcaaaaacataaaatgttggggtagacaaaagtgtagagtttttaaaataaccttctgtaaatataagatgttctgtctaagtcttatgatgaccacaaaacaaaacctatagtaaatacacaaaagataaacagaaaggaatcaaagcataccaccatagaaaatcatcatatcacaaaggaagacaaaaagaggaagaaagaaacaaaggacctacaaagcaaccagaaaacaagtaataaaatgacagtgataagtccttacctatcaataattaccttgaatgtatagggattaaagtctccaatcaaaagacagagtgaccgaatggatttaaaaaaaaaaaaaagacctagtgacattctgcccacaagagactcatttaaactttgaggagacatatattgaaagtgaatagatgaaaaaatatattgcatacaaatggaaaccaaaagagagcaggagtagctgtgcttatgtcagacaaaatggactttaagtcaaaagctgtaaaaagagacaaagcaggtaattatataatgaaaaaaggggtcaattcatcaagaggatataaaaattatgaatatataaggctgaataacattccactgaatgtatacatactacattttgtttatccactaaatctgttgatggacccctgggttgctttcacgttttggctattgtaaataatgttgctataaacatggcggtacaaatatctgttcaagttcttgctttccattttttgtggtatatacccagaagtgaagtggaattgttgtattgtggggtagttatatatatatatatatatatatatatatatatatattatgtttttccacagcagctgcaccatttttacatccccaccagcaatagacaagggtttcaatttctccacatttttaccaaaacttgttattttctggtttgttttttactttttatttatttatttacatatttattttttgagacagggtctcattctgtttcccagactgaagtgcagtggtgcaatcatggatcactgcagctttgacctcccgggctcaagcgatcttcccacttcgtcctccatagtagctgggactacaggcacacaccaccacacctggttaattttttaaattttcttgcagatacagggtcttaccatgtagcccaggctggtcttgaactccttggcttaagccatcctcctgccttggccccccaaagtgctgggattacaggtatgagccaccacgcctggccttctggtttgtttttttaacaatagtcttccaattggtgtgaagtggtgtctcattgtagatttgatttgcatttccttactgattagtgaggctgagtatctttccatgtgcttattggctctttgtatatcttctttggagaaacatctactcaaattctttagccaatttttaattgttttttgtcatttgattttttatttatatggattctttatatattatgggtataaatcccctaacaaatatatgactgtaaatattttctctcattctgtaggtttttgtttcactttcttatgctgttctttgaagcacacagattatacctttgatgatgtctactttatctatattttgttggtattgcttgtgcttttggtgtcatatctaaaaattcattttctaatccaaggtcatgagacttcatatctgttttcttctagcagttttatagtattagcttttctagttaggtctctatggtctactttgagctaattttgtgtatggcatgaggtagaggtctaacttctttcttttccacgtggatattcggttgtccaagtaccatatgtataaaaggctatgctttcctcattgacttgccttgacatcctccttctttttattaaattcaaagtgagtacatggtgaatgaactcccattcataattgccacaaaaagaataaaatacctaggaattcagctaacaagggaagtgaagggcctattcaaggaacactacaaaccactgctcaaagaattcagaggtgacacaaactaacggaaaaacattccatgctcatggataggaagaatcaatattatgaaaatggccatactgcccagagcaatttaaagattcaatgccattcacattaaattaccagtgatattcttcacagaattagaaaaaactattttaaaatttatatggaaccaaaaaaaaaaagagcccaaataaccaaggtaatcctaagcaaaaagaacaaagctagagacatcatgctacccaactttactatattactatactacccaactatactatagggctacagtaaccaaaagagcatggtactgatacaagaacagacacatagaccaatggaacagaatagagaactcagaaataagactgcacatctacaaccatctgatctttgagagacctgacaaaaacaagcaatggggaaaggattccctgtttagtaagtggtgctgggagaactggctagccatatgaagaaaattgaaactggaccccttccttacactatatataaacatcaactgaggatgaattaaagacttaaatgtaaaactttaactataaaacccctagaagaaaatctaggcaataccattcaatacaagcaaagatttcatgatgaaaatgccaaagcaattgcaacaaaagcaaaaaatgacacatgggacctaattaaactaaagagcttccgcacagcaaaagaaactatcagcggagtaaacagacagcctacagaatgggagaaaatatttgcaatctatgcatctgacaaatgcctaatatccagcatctgtaaggaacttaaacaaatttacaaaaaaaaaactccattaaaaagtgggcaaaggacatgaacagccacttctcaaaagaagacatatatgtggccaaaaacatatgaacaaaagctcaacatcactgatcattagaggaatacaaatcaaaaccatagtgagataccatctcatgccagtcagaatggctattattaaaacgtcaaaaataacagatgctggcaaggttgtggagaaaaacaaacacttttacactgttggtaggagtgtaaattagctcaaccattatggaaaacagtgtggcgattcctcaaagacctaaggacagaaataccattctgcccagcaatcccattactggggatgtacccaaaccactgtatatattcgttatatatgtgaagcaatataaatcgttctactataaagacacatgcatgcatatgtccattgtagcactattcacaatagcaaagacatggaatcaacctaaatgctcctcaaccatagactggataaagaaaatgtggtacatatacactatggaatactatgcagccataaaaaggaacgagatcatgtcctttgcagggacatggatggagctgggggccgttgtgcttagcaaactaatgcaggaacagaaaaccaagtaccacgtgttctcacttatcagtgggagctaaatgatgagaacacatggacacatggggggaagaatacacactggggcctgtcagagggtggggagtgggaggagagagaggatcagatagaataattagtgatgctgggcttcatacctgggtgatgggatgatctgtgcagcaaaccaccgtggcacacgtttacctatgtaacaaacctgtacatcctgcacatgtacccctgaacttataagttggaaataaaaaaaaaagtgagtgcatgaagttagaaaaggacgcaggagaaaatttttcatgtggtgatctttagaacctaagctttaagtttgttaaaccttcatgtttctcatgagtaaaatatggtaatgagcttagtacgatactgttgattacaaagtattgaggggtacatatcacattttcagaaagtatttaccttcacagtctggagttataaggtatttgtatgcttctttgacaaatacctgcaaatgtaaatatgcagaaggttaattgagtttttgaatgccatttctactgaacaggagagtttcaggtataaatgtctttgctatatgtaaactaatattacatgctctttcagcttctctttttcatacccaataaagcttttagtaaataaaaatgatgcagatagagaaaatgcttcttgaggtgtattttaataggaaaagtttctgacctgtcagtcagtttttaaaattccagagaagtgtctgccatggctttttttttagacacaaactaacaaaaatgtcacacttatgctgtgaccacagctactattgtccccacagagctagggaccaaaaaatcttccagttctaataacatatttgaatgctaggataaaccaattgaaaaatagattagagccacgaagaacattagagatcatgtaatatttagctcacaaatttagtttgtttgacagtgttttaacaattaaaattagtttcccctattttttaaaggaaataatttcaaataaaaggttgaacttttcttgaaaaccagatgctctggcaatcctgggcctgcattctcacatggtaacaatgggctggaactgagaagtgttcttcaggtcatcactcactcttgtccctctgacactaaaatgcttgtttcatttccatgaatcattacacttacagttatgtttcacgtagcagcccatttcatttattaatgttacctgcctggaccctcacatctgattcaattctcaccccactccccctccatattagctttctaatgctgctgtaacaaattactacaaatttagtggcttaaaacaacaaaaatttgtaatctcacactcctggaggctagaagtccaaaatcaaggttttgggaggtttggttccctttgtgggttctgaaggagaatctgttcatgcctctctggtggctgctggcaaaccttgctattctttggcttgtggacccatcactccaacctctgccttaatcttcatatcactttctcatctgtatctgtgtgtctcaaatcctcttctgcctatttcttataaggacacctgtctttggatttggggcccaccctaaatccaggatgatctaacattgagatcattaactaattttatctgtaaaggccctttttccaaacaaggccgcattcacaggttccaagttaggacatgaacttatctttttgagaccactatttaactcactacaactccattttaaagataagaaaactgaatccaagacaggtttagttactcctccaaaatcatacaactagtttgtgatagaattgattcaaaaacattagtcccctaactcccaaatgagtttcctttccactattttatgttgctcttttacttcagatcagttcatgttccacataaaatatggaataaacataaagaataataagtttcctctagctctatcactttgtaattttgtgcattattttagctgatggaaatctttaaaatgtgtgatctctttaacagtttgttattctctattaaaatatcagaaattagtacataaaccagttgcatgttaatttaaagctgtctgaagaaaagattttgttgttgttcaaattctggctctgttactaaattgctgtgttttcctgggcaagtcccatcctctctctggatttcaatttgcccacttgtaaaacaaaggagttggaccaagatgaattctaaggtctcccccagcaccaactttctgggattctgtttttgcagaattattctgaatgtggttaatcagccactttgaggtactattgtccagctaagcttttaggaatagtagtttccagaagagaaaatctatttcaccaccacctctattttgagttgatttttgtatatggtataagaaaggggtccagtttcaatctactgcatatggctaggcagttatcccagcaccatttattgaatagggagtctttcccccattgcttttgtcgactttgttgaagatcagatggttgtaggggacggctttatttctgggctatttctgttccgttggactgtgcatctatttttttaccagtaccagtaccaatatttttggttactggagacttgcagtatagtttgaagtcaggtaaggtgatgcctctagctttgttctttttgcttaggattgtgttggctattcgagctcctttttggttccaaacgaatatttaaattattttttctaattctgtgaagaatatcattggtagtttgataggaatagcatcaaatctgcaaattactttgagcagtacggccattttaacaatattgattcttcctatccatgagcatggaatgtttttccatttgtttatgtcatctctgatttctttgagcagtgttttgtaattctcattgtagagatctttcacctccttggttagctgtattcctaggtaatttatcttttttgtggctattgtgagtgggattgcattcttgattttgttctcagcttggatgctgttgatatataggaatgctaccgatttttgtaccttgatgttgtatcctgaaactttgccaaagttgtttatcagcttaaggagcttttaggcagagactatggggttttctaggtataaaatcatattgtctgcaaacagagatagtttgacttcctctcttcctatttggatgtcttttatttctttctcttgcctgattgttttggccaggacttccagtgctatgttgaataggagtggagagagagagggcatccttgtcttgttctggttttcaaggtggggtgcttccagcttttgcccaatcagtatgatgtggctatgggtttgtcatacatgactttttattattttgaagtatgttccttcaatgccacatttgcggggtgggattaacatgaaggctgttgaattttatcaaaggccttttctgcatctattgagatgatcatgtgtttttgcttttagttctgtttatgtgatgaatcgcatttattgatttgcatatgttgaatcaaacttgcatcgaaggaataaagcctacttgatcacaccacctctattacgatgaggggatgagggtactttaagtttagtttccagcggtgagactggatttgtacgatgccatccatcttcctcctcaccccatcccttctttgcagcctttctcaacctacacacacacacacacacacacacacacacacacactgatgcacatacccttatcatctttctgtcccagtatatagccattgaaaaagaagtcaactggcagaccaagatgtcaaaccctgattttaaacactttaacaccatcctgaaaccaaaaaatacccgttttgactataaacaggtaaaagagtaaaaataaaaaatcctacattatataaatgttgttctgacaaactgttttcaccctgatttctcttcattgtgctctaatttttaaaccttcttgacatttgactttataggctacaactttccactttccacatttgactttataggctacaactttccactttccactttccacagcggtaattatcatttgttctgtggctagttctgaaaaaggagccaggaaatttgagcttccagcaaaatctccctgagtataattcactagataaactgtacaagtctattctcttttaaataaattacttgagttcttacttaaatgatgtactgtattagtttgccagggctaccttaagaaaataccacaaactgtgtggcttaaacaacagagatttattttcttgcagctctaaaagctggaagtctgagatcagacttccagtcaggtatcagcaggattgatttcttctgaggtctctctccttggcttgcagatggccactgtcttgctgcctctttacatggtctttccactgcctctttacatggtctttccactgcctctttacatggtctttcctctgtgagcacgcatttctgatatctctctgtagattctaatctctcttctgataaggacaccactcagattggatttaggcccactcagcctcatgttaacttaattacctctttaaatatcttatctccaaatatagccacattgtgaggtactggggggactggtgtgacatcttggtctgccagttggcttctttttcaatggctgtatactgggatagaaagatgataagggtatgtgcatcagtgtgtgtgtgtgtgtgtgtgtgtgtgtgtgtaggttgagaaaggctgcaaagaagggatggggtgaggaggaagatggatggtttcgtacaacatacaaatttggggagaagaggacacaattcagcccataacatgtaccatattatttcacacattatgaaatgttaaacctagaagtaatttagagactatttagtataatcctctcattttgtaggttataaagactgaggtacagggaagttaaaaacacttacctaaggcaagccatatggaattagtggcagaggcaggactagaaatcaggtcttccagctccaagttccatgccctttccaccataccatgctgctactttagtccatttgacttattcatgcctttaacttctcttcttctcactcttcctcttgatgatttagaataaatttggcaaatatattaaattagctatttttaaaactatatttaccttaattttcctgtacttactaccctccacaactcaaattttgaaaataaaaatatttaaggagttttctacttaatttcctatcacttttctctttatacatatatttttcactcttgctttgaaataacaggatttttctaaggtaaatgaacttttgcttgccagaatagacaatgaattgaaatcaaagaaccctcagctttttgtcacctttttgggatctgaggtagagaaaaaaatttgcacaaacctatgcctctcccctttcttattacctgtccttctctttccctacagtaggattttaaagcttctagaaactttgatatacacactcctcctccctcccccaccaaaacaataaataccatcattgaactggtgccataaaaagtgcctgatttttcattctttagccagaggtatttaagctcaaactttggaacctgaaaggaaagaaaattctgaatataaatgtacctttcctttacttgtaaatcttctccattcgccttttagagtgaaatatcaagagagaaaagggagaaactttgagttataaagtgagtgatatgaatgtttaagacatttattaaaattaggtgtactcttccatttaatccagggttttacttttacttaaactactaaagaaactatttcttttcaatagtcagctagttacttcagtggaccagggaacacttttttctctcctgtctaaagctccagttgtttgcttcttgagagatagatgtttaatgacaaaaagcctttcttcaaatgagtcccttgggtaacatagcccccatgctgcccctctcttaccttgctgattactaaggaattcatctggataagtcaccctctatggagacaagaaaggggcagggattcatcccatcctgcctctagtgcaacgtgtcagagcttgatcctattgcctgcttattcagtacagacagaaacactgggaagcactaaaatatagatgtctgtgccattaaggtacaaaagactattaaaatatgtctgtcaagcagatctgtattgtatcacagtcttaatgattttgactgtccagaagatagaaatatagattaaatttgattgacatgctctcagactggacatgaatgtgtgggtgaaagtaagtacaggatcatattatttaataaacaatttggacaacatgaaataataaaaacagtgatttctttttcaaatggcattctcagagggtctagaaatttctgatttggtggaggggggttggctataggactcgattcctccccctacccaagtaatttcgactggaagttccatatgtatttttattgtggtaaaaatgcataaagttccactttttatgctttaagattttaatttctgttttctagttcatttgaggttgggcatggtggctcacgcctgtaatcccaacactttgggaggccgaagcaggtggctcatttgaggtcaggagtttgagaccagccctggctaacatggtgaaaccccatccctgctaaaaatacaaaaaaaaaaaaattagctgggtgtggtggcaggcacatgttgtcccagctactcaggaggctgagacacgagaatcgcttgaaacccgggaggcggaggttgcagtgagccgagatcacaccactgcactccagcctgggtgacagagcgagactccgtctaaatagaaaaatcaataattcatttgaatagaaagttcattggtttctaaaaaatgtcctaaagtactatgagagaaaattttttcctgatatctgaatatgtttatataaaaaatcttggctatataaaataaaaataagtgttatgtattgaaattttttattgaaaaccatacaattggaactgccctggttgttgtaccttttgaacaaatttccttcacatagtgacaaattgcttttgtcatcttttccctatccttgttttcagcagtcagaatagcaaggtccactatgttgtctgatgtgcctacagccaggctctgatggagacagagttctcttgcttttttacttctttgcaattaccatggctttcagcagacatttgcacccctgtaacttggtgggtgctgcttttgctatgatttttaagtgtcatcttctatgaagtatagtactgaagaggagttattgtatagtgggaataaaactgttgagctccactggatggttcttttaatgtgagatcataccatccagtaagactcagagggatatattgaaatcacacatttgagaatcacttccattcttctccagcactattgcttatcataaggattgaactagttccgtgagagacacaatgaggtacatctggtgggctagatttgctgtaatagcctcatcaaatggtccatgttaatcacagcaactagcaattgctttaccattgttcaggttgtcatttgcaatctgattatttggtaatgaactgcccttagccgacctgccaacctcaggtctgtttacgaaacctgtgacattatgagaaatacagtattcctagtagtataatccaaaaatctagaaaaccatgttgcaaatgggagggaggtcataattcctgtctgagtattggaagttgcaattattaacagttgtgtgtgtgtgtgtgtgtttgtgtgcgtgtgtcactagataatatgtatatacatatactgtaattattacaatatatatacagtgaatacatatatgtaatttcttaactgttcctacccactctattcattaattccatacaattatatatcactttacattctccaaaatacttccgtatacattcttgtttaatccttatactagctctgttagtaaaaattgttctctattttataaagaaagtgaagctatgaaaggtaatatatcttgcaagatttcagagctaggaaatggttgagtccgaattgtttttctaaactcctagcctactgcttttttctgttacaccccagctatctttgttatagaggcagtgtgttataatggacccagactgcccggatttgaatcagagatcttttacttcctagtggtatgaccttagacaaattattaaacctctctgtgccaaagtttcctcatctgaaaaatggggttaataatagtatctacctttgttgtgaggattaaacgagttgatatagagatggtgtttggaacagtgacttgagtagttagcattatgttagtgtttgatgctattattacctttattattatcattcttgtcataatcagcatattgcatagcatggtggctaagatctctattttttaagatctcagtcactgcatgcaaacagtctagattcaaatccaaactctactactgtgtgaccttggacaaattactttgactttctgtgcctcagttttatcataaatatatatatcatatgtatgatatatatatatcaaacattgggctaagtatgttatatgaattaatttagtagtcataacagccatgtgtgactaacactttatatatttatgatatatatattttaatacatattttatcataaaaatatatatcataaatatataaagtgttagtcacacatggctgttatgactaccaaattagttaattcatgtaacacacttagcccagtgtttgatgttagaacccccacttgccttattcctaacatcttggctgcaaactcagacccatgaggtgtctgtatggcagttgtatattgtatatgacatatgtaattcatcagtcctctatagtctaatcacacaagctagtggtttggttgtcatgatagttcttggtaggaatgtgtttgtcatataaaagttattttggtatggtgtggtgaaatgagtattcactggagatctggttctattgccgagtggccttacaagtgaaattctggagcctggagaaaaaaactttagcaagagtaagaaatgaattctcagtcaccctcttttctctctccctactaatgctgtaatgctatattttccagcctatggtggggtgggtctatagtggtaagacagtgtggtatcattatatttaggaagaaaattgtttcaagtttgaaattttttccaatattatattagaagtcaactggagaatgatatttacttagtagttattttagaaataacttttctaggcccaatctattaagaaatgaaggagatcatcctacagacagatcacaggcaaaccctcattttagggaatgactttattccagaagataatttctaagttgatagtttggcacttgaatatttttctatagaaattatgttatttttctgtagcaattaggttattgtgttattatgctgaagtttccaggttagcctacaacctgtgaaaggattgaaatactgtgatagaactgaaataccgtactgtactgaaatactgttaactagcaattaaagcaaaatgtaattgaataagaaatagcaccttgacactaaagcatgagcatagcagagttaattacaggttaagaagatagatggaggctttgggagagtctttctgaagagcacttctaggtactttcaatggacattagaagttgatggcacaggttttatgtctaacttcagaaaggatgacttttcttttccttgatacagctatctcacagtgctcttataactatcagccattattagggctatttggggttcataaatagaacaaagagaccaagaaaggtaattttgaggtaactgggcaagaaatagcagaagaaagaacatttaaaggggtaatatggatccatgtgaggttatgtgattgcttaaggtggaattgaccacagtaaatgataaaaagaagaaaagtggggagctcagtttgtgcgtaggatcccagtggaaagaaagacagtgagaagctttccaggaaaccccagcacctttttaacttcaattcacacattctttctgtactgttccttttgtgttccctttctcccctactagactagttcttgaagggcagatatggtttcttattcatccctctgcttccaacaataactagcacatagtaggtgttaacacactgtatgttgaaatgatatcacatatgatcttttaggccaattaatgtgcttcttatttgaccagggcattagaaagctgtaaaattgtgctctcaactagcatttggtacatagttctagcatttgagttgaattcagaattgtaatgttataaatagagaactgagaacccatgcatgaattgtccgtttggtatagacctagtctcttttccccatttcatgagtgacatcatcttttctttctccatctctctgtcttggagcatggtctggccaaactaattttgtaaataccctaaagatggagctttggacactccctgattgacaaagctctctggagcttttataccttctctcagaaacacatagtaacattctggttccaaagagatggtgtagagtttgactattgattctttgtcctgcttgcttgcttttgttctgtttgaccccttccctgatgcattcctgctggagacaaacccacatgctgaaccatggggaacagtctgtaatgaaacaacaagctgctcccaattttaaatattgcatgttggggcaaaggcagagttccttttcctctaaagctataacattaaaaaaattctgtttgatattcagagttatttgatctggcagtttaacaactgttgatgttttaattgcttctttaaaggatttcatctacatttctaggtttatttttattttactctgaaggaatgtcaatattagccatcattttgcccagtaagttcccattgcaggatcttggagtaaaatccagtaattactggagctggtaacttaagaccctgctgagaaatttggcagcttcacttttcctgaggaggcatctctccccatggagctagcaatcatttattgttctgaatcaattttaagtgagttttgtaccttagagaccagctttctatgttcctttgaaagctatttaaatcattctttttgggtgaaagaggaatgttaagtcatgttaagtcactctttttttgtatgcacctaataagagcaacaaagtaactcttagacaaatgtacaattgtaagatgtgctagcaagaaaaatttagcaagtttataatccctcagggtcttacttcatttttatttgtctattcataagtttatttccaagaccaaatagaatgttttgttggcgtgctacttacatgtatgcagctagccatttgaattctctcaacaaaactacacacattcaaagcagtttagagatgaaagggtcctctgagatcatctagtctagcctcttctaaatgctttaaccttgtatttattaataaaaggagagctggatgagcttgcatctttgctcttctgtcatatatcctttgaattattccaatgaaaaaaatgtttgttaaatgcttagatgctgaacccagtctgaagcaatttgcttcagaaggcatggttcttagagttttggagcctacacagtaaaaccaatagcactgacatattatatattgtctgtcacattttctcttctgaagtttctttacactccatcatcacccctaccaggccccctccgcacacacacacacataaacacacacacacacacacacacatatcttggggagatgaaaacaaatctcttaaacttttatttttctgctttgaagccacactcccagaaaagacttttttttaaaaaaagtattttaaaaattattaaatttttaaaaattttttttgaaaatttaaattaaaaaactatattatgggtacataatagttgtacatatgtatggggtacatgtgatattttggtttttgttttgttttgagacggactgttgcccaggctggagtgcagtggcgtgatctcaggtcactgcaacctttgcctcccgggttaaagtgattctcctgcctcagtctcccgagtagctgggattacaggcgcccaccaccatgcctggctaatttttttgtattttttttaaagacggggtttcccatgttgggcaggctggtgtcgaactcctgacctcaagtgatccgcccctctaggcctccaaaagtgtgagattacaggcgtgaaccaccacccccagccacatgtggtattttgatacaggcacacaatgtgtaatgatcaaatcagggtaattggaatatcagtcatctcaagcatttatcttttttgtgttaggaatattccaaatcaattcttctagttattttgaaatatacaagaattattgttaactataattgacctattgtactaccaaacactagatattattccttttattcaactgtatttttgtacccattaaccattccctcttcccctcttttttttttctttgagacactatcttgctctgttgtctagactagagtgcagtggcacattcatggctcactgcagccttgaactcttgggctcaagcaatcctcctacctcagcctcccaagtagctgggattacaggcatgcaccataatgcctggccatttctttaaatctctgtagagatagggtctcactatttgcccaggctggtctcaaactcctggacttaagtgatcttcccacttcggccttccgaagtgttgggattacaggcatgagccatcgtgcctggccccctcttctactctttatccaccctccccactagccttcccagcctctggtaaccagatcattttactctatcaccatgagttcaatttttttttgtagcttccacatgtgagtgagaatgtgcaatgtttgtctttctgtgcctgacttatttcatttaacatggtgatctccagttccatccatgttgttgcaaatgacaggatctcattcttttttatagctgaataggactcctttttgttataagtaccacatcttctttatccatttgtctgttgatgaacagttaggttgcttccaaatcttggctattgtgaatagtgctgcaataaacatgggagagcagatatttcttcaatatactgatttcatttcttttacacatatacccaacagtgagattgctggatcatatggtagttctatttttagttttttgaagaacctctatactgttcttcatagtggctgtactaacttacattcccacagcagtgtacaagaattgccctttctcttttacccttgtcagggataatcaaaggttaaatgaaaggaccagccaactgattgatgggagggacactggttaggatagttgaggagaagtggacttagccacaaggtgtattattcagctttcccatatttttccttcctttactctatctcctcaacactgggaatataagacttttcactcatagacttaatgtccaacaaactttttgggaaatggaagcaattactagttcagctgtctggttcttcctctgaatttttttttttaatgccgaaaacccagaaacttccaaatgaatctcctggccttttctactggttatttcttgtgcagcttcactaggcttaaaaggtcagcctcttcattgggccatgatgttatgattgtaactctagactattttcttcttggcatcccttctcaatagatagcactcagtgattgaaagtgtaacagattgctactgtgtgaggaatttcagaatataaactatggtagttagaaaatgatatggatatagtatatgttagaacccgtctttgcctggatcacttttcatgagtctttttctgttgatgttgacccgttctagcccctccgaacctaaggtttttgtttttgttttcacttgacttaactagaccataagctccatgagggaggagactatcctgtttgccttattcactgctataaatttccatatctcatatgcctaatataatacttggcacatagtaggcatccaataaatatttactgactgaattaaatagtcagtagtcttgtcctagttcccgtatttgctacagtaagagccctcttgctgaactctgcctggttattgatgaaaccaggtcatctatgtcttctgtttatctttgagtatagactataccccagcaacttccaacaaccttctggcagcaatatttttctgattgcccactcttaaaactcttcaagtgccctcttctcacaccagatttctgtcctaactaaccatcctacgtcatttctgacaaaatctttcctttatctattgttcaagattatatgagttcaaaaatttcttacgatgtactgtacttgcagtcagtctcctacttgatgtcctatagaacacaaagttacatttgcataataagggccacctcctttctatctcccagaagggctaccccaaatcataaatagtaagaggaatcttttgagcacaaggacaaaaagaagcaggataactccattttttgaaaagaaaattttaaaatatcacattgagatgatggtgtgaaagtactttcctgaagttaaatttgcaagtgtctgccttcttctctcctctgggtatcacactgacacatctgccattcgaattggattttgtgaagcttttgaattgtgagtgacacagaatgctgtggctttcagaatgtctttgtattgttccctcctgagagctaggatgatgggatatattatggtggtgctgtctgtattctcaatcatcagcgcaaattgacagcagcaccataaagtcaggtttattggcacgcgtgcacgcacacacacatacacgcacgcacacacacacacacccctacaggttgttagagtacaagttctacagtatttatgtaaaagaaaaaagaatacttttagctaaacgtaatgtcttttcttctctgtatttccatgcatacctgagaacataaaagatattcaataagtatgtggaaaagttaaaattgttgccttgatgacagtttcatttctcaggctgtagaataattcaagcaaggaattgctactctggtcataattctgaaaaggaagaaagaactgcttggtgagatagtgatgataggcaccttgggagaaagtgagtgtgtcatactagagtttgtaataatgaaggaagtaagtgctgctgatggttccacatctattataggctttacaaaagcatatttcagaaattagggaaatgaaagataggtatgtcccccttgtcttgatatactacatttttttaaatgataagaggctttcaaagttgaatactcctaatttcttggcaatagagaaggaaagggagtatctaaaacagtcatattcaacatttcctgtgccctaacacacaccagaaaggacatgacatatgcctagtaatagtgctcactacagaaggtacaataacacacatcacaatttatagagaagcatatgtattttgaatccccacccaaagggccattctcctctccctagcctctacacatggtgtcattgttttgtgtgactgcacaggaagttatttgataagttcagatgtgacatgttaaaaggaagaacatagaaccaagtacacattctagacaaggacattattctataaatagtatcaggaaagtcagagccttgtaaaaaaaaatgttaaggaccactaaatgtgtacatatatttagttctgtttagagcaagaacaaggaagagctaggcctacttggcatcctgttaaaagtgacagctggcagaactattcaaccagacttctgtattaatgatattgatgttcaaacagaaaagggtgaatggaacatggttaagaaggaatttttgaagctcaagttagatgagaaattagaaaagagatatctattccctttgagtctctaatcccagaagaactagatctaagagaaaagaaaaaaaaatctagagaagaaaaactagatctatgagaaagaagctgcagagatagtcacaaaactactactcccagtttttgagatgtcataaagggtaaattccaaaagataaaagatggacaaattccctgattttctcagagaggaaggttgggagtgatttgctgaagctatggatctgtacacttgacaattactcccagcataattctaaaatgtattttcaatgagatgctttatagacattcattaaagaaaataatggccactgggacctccaagttggttctctaagaagtcattaagaaaataatatttatgtgtcatttcttgataggatcactaaactagactttaagggcaagacatcataaaatagggatccagtaagataattaatcctatatcttgtgttatccttgtagagaccaggacataagagaagactgatagcagttggaggaatttaccttggttgaactctgtgtattcatttcaatgtagagggaattactgagtagcttaccatagagctctgtcctgttcaacactttcatcaataacttggacaaagatataaaaagtatatatatatatatataattattggattatacaaaattagaaacaacagataacatatgcatgacaaatggcttgtctggtatcaaccaaggcaaggtaccatacttcaggaatcactggaaaatattgcatctggaggaaggttttacttaggggctgaaaaccatatctgatgaagaatggggattttttagctttgcaaataaaagactttagtgggacatggtagtggtctttaaatattagaaaaaatggtatatgtaggagaaattagaatgatgagggaatagttggaactgagtggaggatatataggaaggaagattttggcttagtttaggacaattttctaacatttttttctgtttaacatagtagtggtctgtttaataagttagtgagctccttccctatcaatagaggaattcaagcagaagctagacaaccatcttttggagtgattgttaatgtgattctttccttagaggaagatttagacaagatgagttctgaaatctcttccaactctgagattttatgattactatctctactggcagtttttcttgttaacaactgtgtccatcataattttcaaagggaaagtcagtaatcctgaaaattacatcacagatatcctgtttataaaacttttccccccaaatgtttattttccatcttctcatatcttccttcctttctttccttcccattacccatttaaaggcatattcaattagtaatacacctgtagtgataatcagagccctacttatttataccttctacaattatttgggtttttttgtttgttggttggtttgttttgttttgttttgtttgagacagtgtctcactctgttgcccaggctagagtgtaggagcttgatctcatctcagctcacagcaacctctgcttccaggttcaagggattctcgtgtctcagcctcccaagtagctgggattacaggtgtgtaccaccacgcccagcatttttgtgtttttagtagagacagggtttcaccatgttagacaggctggtgtggaactcctgagctcaagtgatccgttcaccttggcctcccaaagtgttgggattacaggcgtgagccaccgcgcccggcccttctacaattatttgtaccatcagaatgagctataaatttgcttgctcttttcttttgtatgtatgtgtttggagaaaaaaactttacaacatttttaacagaataagtcaatatttattttgaaaaagtgatatactgcttagtctccaccatccacccagtaaaacaatctgtcttctagaagtatcaagtactgttttatcatttaggatgtcacctgaaaagattaaggatagtccaagcattctagtatcccctattaaatgactatggatttatctcttgtctataaatgtatacaatttttcttgaaccttttttacccatttctattttcagcctaaatcatttctaagtataatgatgataatgaactcataaatttttgataaagtagtatgcattttcttccacacaagtgtttggcattgttgcatatctcttttaagtggataattcaacagttattaagcccctactatgtgttaggcagttttatatctattattaaagtgcttatgaagtagatggaattactcatagatttgggtttttttaattaattatttttttttttagaaacaaggtcttgctacgttgcccaggctggcctcaaactcctggattcaagtaatccttctgcctcagcctcctgagtatctggggctataggcacactccattgcacccacctactaataggttttaactttggttttcagtgggttatctataatatgctaggtaaaggagagagagagagagagagagagtgtgtgtgtgtgtgtgtgtgtgtgtgtgtgtgtgtgtgtgtgtgtgtgtttcagtcttcctaggggtttactgtacttcttgaatctttaatctatacatttatatctttgaccaaatttggggaaattttgaccatttcttcaaatatttttctaccccattttctctctcctctccttctaagatttcaattacatatgtgtttgaaccttagctttcatcttacaggtccctgaggctctgcttattttttccaatctttttccttcctattgtctaagttggacttttctgtgaatctatcacgttcactgactattttgtcatttccattctgctaagtctgagggtgaacttttatctcaaatattggatttttctgtttcaattttttctttctttttcagttactatttctttgttgagattttctgtcttttactttatgcagatatgttttcctttatacgctgaagcataattaacaatagctgccttaaaatcttgtctgctgatttcaatgtatgtatcacttcagagttggtctctgttagaatgagtaacattttctagtttttttcatatgttgaatgtgaaaaaacatattgtatactggatactatgaaagattgtatactacatactttgtattatatactgggtactataaaagattgtgttatagaccctctggattctgttacattcctcaaaagagtatttttttaagcaagcatttaacttggctgaactcaaattataaaccctctctcccctgcagtgggaagtagctcaaatctatgttcagaacttttatgtttagctgggctgcttgtagtctgccctgcacatgtacagttcaagtgttagccagcgattcagacagaatctatatccagaatttaggatcacctctggctttctgctttctaggatttctccctcactttccaatagctgtagatgcccactctgtcctccagttctttaaaccagtgggaatgcagatttctatctgagttctacacactccatgagatgctaaaagccatttttagaaacagaaaactcactcaatttcccttattttaaatgtcaactcccctctcatgtgttccatctgtatgcttgttttattctccagtgctttcaggtagctttttactttttcttttatccagagttacaggcacacctcagagatatattgtgggtttgtttccaagcaaccagaataaaactaatatcataataaaatgagtcatatgaatttgggggttgcccagtaagtataaaagttatgtttacatgatactatagtctgttaagtgtgcaatagcaatatgtccaaaaaaacaaactacataccttaactcaaaaatagtttgttgctaaaaaatgctaccaatcagctgagccttcagtcataatctttttgctggtgaagagtcgtgccttgatgttgatggcagctgactgctcggggcagtggttgctgaaggttgaggtggctgtggcactttcttaaaataagacaacaataaagttcgctgcatcaattgactattgttttcacaaaagatttcactgtaacgtgatgctgtttgatagcattttaactatagtagaacttctttcaaaattgtgttaaatcctctcattgtcattccaacagtgttcacagcatcttcaccaggattagatcctatctcaagaaacaacttcctttgctaatccataagaagcaacttcttatgtgttcaagttttatcatgagattgcagcaattcagtcacatctttgggcttcagttataattctagatctcttgctgtttccaccacatttgcagttacttcctccactgaagtcttgaacccctcaaagtcatcaatgagggttagacgcaacttcttctaaccttgtattaatgttgatattttgacctgcttccatgagtcatgaatatgcttaatggatctagaatggtgaatcctttctggaaggttctttacttactctgccccaatacatcagaggaattaccatctatggcagctgtggccttatgaaatgtatttcttgaataataagacatgaaggttgaaattactccttgatccacaggctgcagaatgggtgttgtgttagtagacatgaaaacatttatctcctagtacatctccatcagagctcttgggtgaccaggcatattgtccatgagcagtagtattttgaatggaatcttttatttttctgagcagtaggtctcaatactggacttaaaatttcaataaaccatgctgcaagcagatatgctgtcattcaggcttttttgttccatttctagagctgagcaggatggatttaacataattctttttcttttcttttttttttttttttgagacagggtctcactctgttgcccaggctggagtatagtggcattatcttgactcacgcaacttctgcctcccaggttcaagcaattctcccacctcagcctcctgagtagctgggactacagtcacacaccatcacactcgtctaatttttgtatttttagtagggacagggtttcaccatgttggccaggctggttttcaactcctgatctcaggtgatctaactgcctcagcctcccaaagtgctgggattacaggcatgagccaccacacccggtgaagatttagcataattcttaagggcctgtgatttttggaaaggtaaattagaattggcttcaacttaaaatcaccagctgctttaacccctaataacaagagtcagccaatcctttgaaactttgaaatcaggcattgacttctcctctctagctatgaaagtcctagatagcatcttcttccaatacaggattattttgtctgcattgaaaatctgatgtttaatgtagcaaccttcatcaattgtcttggctagatttttctggataacctgctgcagcatctatgtcagcacctactgcttcatgttgcacttttgttactggagacagattctttccttaagccgcaagaaccaacctttgctaccttccaacttttcttctgcagcttcctcacttctttcagccttcacagagttgaagagagttagggccttgctctggattaggctttggcttaaagaaatgttgtagctggtttgatcttctatccaggccactaaaactttctccatatcggcaataaggctgtttttctttcttatcatttgtgtgttcattggagtagtgctttaaatttccttcaaacacttttcctttgcattcataacttggctaactccttggtacaagaggcctagctttaagcctatctcggctttcaacatgcctttctcactaaacttaacgatttctagcttttgatttaacatgagagttgtgccactctccctttcactgacacttagaagtgattgtaggtttattaattggcctattttcaatgttgttgtgtctctgggaataggaaggcctgaggagaggcaaagagatgggggaacagctggttgttgggtaagtcagaatacacacaatattttttaattaagttttctctcttatatgggtgcagtttgtagtgacccaaaacaattaccctagtaacatcaaagatcactgatcacagctcattataacagatatcataattatgaaaacttttgaaatattgtgagaaataccaaaatgtgacacagagacccaaagtgagcacatgctgttagaaaaccaacaccaatagatttgctcaaggtaggtttgccacaaacatctaatttgtttaaaacgcagtatgtgtgaagcatattaaagctactgtcagatcaagcctcttgcagataataactgtattgatctgacaggagcttacatggccatgattagaagtggagccatcctgtaatatatctactcaacatgttttagaagagaatactgaggcccagaaagattaagcgaccttcccagtgtcacatgactagaaaataatagagctaaagtttaaatataggctttctggctcctgatccagagcatttccacatgttactttttataatttaccttttaattttatttttaattgacatgttataattatacatatttttggggtccatagtgatgtttcaatacatataatgtatagtgatcagatcagggtaattagcatatctgtcctctcaaacatttatcatttctttgtgttgggaaattcagcatcccccttctagctatttggaactatataataaattattattaactatagacatcttaacggtggtatagaagactagaacttactcctcccagctataattttatatcctttagatatcagtaatattctttctcaggcattattctcccagatgggtaagtcctgattcttttgtctctcctcatataataccaattactcccattaccttaatgagttttccttgtagatgtccactaaacattttccaacttccttctaatcttttttaggtttccactgttttccagtattggctttcattacataaaaagaggaaagtgtctcttgatttctttccaatgacctttttgaattatatcccagcaacatcttcagggaatggtttttgaggctttaaatatgatttctttgttaaaagtagaagcttagaaactgtaatcttacataattcagattattctcctcctaaatatgttactttattcacccttataggaaattttaccttttctatcctctcataagtctcattaggcctttctttttgtaatgtttcccatttgttgtagcctttcatatagaaagaactttatgtcctctgtaatcttaaacccatgttcttccagatcactagcaaaaatgttaagatagactgtgtggtattgtgaattaaaaaagcatcatggaccaggcgcggtggctcatgcctgtaatcccagcactttgggaggccaaggtgggtggatcacctgaggtcgggagttcaagaccagcctgaccaacatggcgaaaccccatctctactaaaaatacaaaattagccgggtgtggtggcacatccctgtaatcccagctactcgggaggctgaggcaggagactcacttgaacccaggaggcggaggttgcagtgagccaagatcgtgccattgcaatccagcctgggcaacaagagcgaaaaaaaaaaaagcatcatgacaggtgtacatatatgcaaaaactatttattgagtgcctactctgcactggtcactttgctgggtgctgaaggtataataatgagcaagacagacatagtccttgccttcctagggcttttatggtccagtagagaagtcagacaactaaacaagcaataaaaaataaaaactaagtgtggacatgggaggaagtgcagggtgctatggaagcacgtaacagtagaatctaacctgtctggggcgggagagggcagagaaaaccctccagattaagacagattctgatcccagttctgctgcaaccttatgtggctttcttgtcggtgctcctctcttggcctcagttttctctgagtaaataaagttgttgaacaagatagtcttcaacatcttttccaattagttaattctgcagtttcagtagtgatgcatgataccgttaagtgcagactttgaaggcagatacacctgagttttatactctctcgaccccaacttccacatctacaaaatgggaataatgactacttcagggtactggtatgagaattaaatgagatcagttatgcaaggctgaagttacagagaggacacagattaaacatgagccattttccttttatgccaatttcaataaataagcaacttaaagcattatctttgaagtaaaacatttattataaagtagaatgcaacgtttatatgaattttaagataaaccaaagaaattttctattttggtacatgccaccagacattagtaacattaatctctactgttctttttttttttttttttttttttgagacggagtctcactctgtcacccaggctggagtgcagtggcgcgatcttggctcactgcaagctctgcctcccgggttcacgccattctcctgcctcagcctcccaagtagctgggactacaggcacccaccaccacgcccggctaatttttttgtatgtttttagtagagacagggtttcactgtgttagccaggatggtctcaatctcctgatcttgtgatccacccgcctcggcctcccaaagtgctgggattacaggcgtgagccaccacacccggcctaatctcttttctcatgggtactttattgaaaaatttgagaagcactgtgtgaaagtacctagtatggtgcctggtataataatactctttattgagttcataataggaactcaataaatgatagatctggggagtgctcatcattacattttttaatatctagatcagtctcctttgtttattgtccttaaaattgttctcctggtcctacaacttctgtgttaactcatttttttgttgttgttgttgagatagagtcttgctctgtcacccaggctggagtataatggcacgtctcagctcactgcaacctccacctcccgggttcaagcaataatccctgcctcagcctcccgagtagctgggattacaggtgcctgccaccacacctggctaatttttgtatttttagtagagacggggttttgccatgttggccaggctggtctcaaactcctgacctcaggtgatccacccacctaggcctcccaaagtgctgggattacaggcatgagccaccatgcctggccgctcatttttgtttgtaagcaatctgtggtatatgaccttaaaaaaacttgaaaacccaaataaatatcatccattggtttcccattgaccatattcttatttacttcctcaaaaactcttgcaaatgaatcaagacatgatttctacttacagaaaataggttgcctttccccactgagttatgttgccatttacatatttggtcttatagattaaggtgtttgaactcaaaactaggagagtattttagaaccacagtaagcttataaagcccaactcctagtgtttgtgttaacaggtaaaggaatatcatggataaatattatccacagatgatcctcaaaccttcctttacctatcgtttgaacacatttcttcatcagaaactatataccagaggaagaaaattgactaaaatcacttttcatctacatcaagtaatcccagattaactctattttatgctaatcgcctcttcattccaaatttctatggcacttagattatcaattttttaataataatattgttaatataatatgttttaagtcagtctctggttttcatataccttgtgttttgctacccccaaaagatcacaaactcctacgtaagcatgaaatatattttgaggttctctttttatatatatcttattctataatgtctggtaatttacaagttctgtacaatgtagatgcttagtaaccatttgttaactaattttataccttctcatgggtataactactttgaaaaaggcaaaagaatatcagcaggaaagaaatggaagggaattcatgatggcaagtactggtgatgaaattatgcctaaactgaatttatttcccaaattccagaataggctaatccatcctttctgctaaaggaagctgaataccccatcccctgcttttttttttttttttttttttccagacagagtcttcctctgtcacccaggctggagtgcagaggcacaatctcagctcactacaacctccgtctgtcgggttcaagagattctcctgcctcagcctcccaagtagctgggaccataggtgtgtgccaccacaccaggctaatttttgtattttcagtagagatggggtttcgccatattggccaggcaggtctccaactcctgacctcaagtgatctgcctgcctcagcctcccaaagtgctgggattacaggtgtgaaccaccgtgcccggccaggaagctgaatacctattataagtgaaatgtaacttgaactctctgcaaagaaattgttattctgaaatcatctgccttactatgaagtgacagttctctaagaaatgtgttacctttttcctaaaaagagaaccttcactcctttagcagtcaagtgagttaatttcctttcagttttatcaaaaccatttccaaactccagcttagcttttcctgtgaagacagtcaactctggtggtatccgtacacacagactggtttgaaaaaaaatctctgggaaaattaaacctagggttcttttgaaagtaactgattggattcactctaaataaatttatttttgacagataactgagagtatttgtgactggctaacagcaggaactagagtagacttcgtagtctagcaggagttaaaacttgagaaatggccactgatgatgaaaacccatagctgatagataagtaaccatttggagtactacaaaagaaaagccactgataatttattgtattttttaatccccattacaaaaaaaaaaaactcttgggtgcatttataaacacacagacactaaacatgactgggatcacacctgggctattcagcttctccaaactcattaactgaaaagatatagattaattggagggagttcagagaagagtaacaaaaatgattaaggggccagagggattgatttatgagcaaagattaaaagaattttgtctatacaatttaactaagtgatgactaagggggaagagggtggggatacaactgtctgaagggtgtaaacaccaaggagagaggagaataatttactatgcaacatgagaatataactagggctaataagctataattacccaaaggaataacagaatacatatttcagggaaactcagaaccatgagaccgccaacttgtttctcaaggagacactggcagatacttataacattagtctcatccagattaacaagtatgtggtgtgaaacaatcattttatgccattgagctctctctttccccaccctcttcaacagtcttgctttttacattattgtggcatagttcaagtccagcctagtgcaccggtctatatagttttatctttgttagtgccgataagtcaaagtttaattccaatagtggccatacaagagcccttccttttggatttactgtgaatttaattgaaaagcatcaaaataaggaatcatatctgaagaggagaaaatcttggattctgcttcagaagtcatagtatttgtgttttggatctccaataataaactttcaaattatatttaatgtctagaaaagttcaattttagcattattgcaagaaaaaagacactaaaaataaatctttgtaggcttcatgatttgtgtaaactttggaatgtggttcttcagaaaacaaattagtctgtgggtaactgcaggctaagttatttggctaattcctattgtgctatcatgacattccagagcattgctatttaactttgccagataagattttgcatgtcactgcagtgagagcagcttcttttgtatgcatacttttctccttcttttcctttgtgttgggaatcttcatagggtgatcccagtctagaaataccattttttcccttcaccattgcattgacaagttcttctggttttatgttaaattttatacttccttgtcaacatttctcttaaataatatattaatgcaatattttaaataaaatttttatataaacgtttaatgttataatagttttacatttacagaaaagttgtggagataatacagagtccccatatactctatccccagtgtgcccctattacattagtatggtacatttgtcatatcaaatgacctaatactgatacattattattaattaaaattcatactttattcactgtttttagtttttacctaatgtcctctttctgttccaagattccatccaagatgccacagtacatttagtatccccttgactatagtaatttctcagactttccaatgaccttaacagttttgaggagtactagttaggtattttgcagaatgtccttcagttgggatttgtctaatgtttttctcatgactagaatggggttatgggcttttggaaggaagactacagaggtaaaatgccatttgaagcacatcatagcaaaggtacatactatcttcaacttggggaagctgattgaaaaaaaaaattttaagtacatagtatcaacatgacttatcactattattgttaaccttggtcacctggccaagtagtgtttgtcagatttctccactgtaaacttattttgccttttcatatttcactgtttgtaaggaaatcattatgcacagcccatgctaaaggagtgaggaattaggctccacctccttgatggtgaagtatctacataaattatttggaattcttctgcagttgatctgcctattctgacactatttatttatttatttatttatttatttatttatgtctagataaagtgatatttattttatactttgggttataatccaatacgctttattctgttgttcaaatcattctggctttggcctttgggaggtctttcagttggctcctgtgtccctttgatgtaccctcatgcatgtgggcttttattgaacacttcttaacttgatggcactacaagatgctacaggttcatatgtatatttcctgccccagttagtcctatgatcacccaattctccaaggatctctggttccttttattgggtattacaaaacaagatctgagtgctagatgtgctcattgctactgggtgtcattacttctaggccttctcagctgacagaggaagaaaatgtatgtgtatactagcccatgtatgtatacacatatctatgaatatttccatatgtaaccatctgggtctttactaagctaaacatgagttcatactgatgtccccagcgctaatacaataccacatggatcattctaaccttctctcctgcttgcgtgtaacttcctgttgccatccaccatccatttacttgatcatccgattccaatttgtggctatagtggtttcaggcttgttaattcacacctctgtggggacaactttatcaaatatagtagatgcttatctatggttccttttgtctttagtcttacaaactcatttccaaaattacttaggttgggcctttttcccccttgtccttcagagaagttgtttcatacatataattagattcttttgtcaaattctgtatcccatcctgagatcaatcccctgatgacttcttcttagattattttttaacttttgcatacattaagatttactttttggcctgtaaaattatgtgaagtttgaaaaatgcatagtgttgtatatccaccattacagtatcatacggaatatttcatcaccctaaaaatctcctgtgtcccacctactcaaccctccctcctcctccacatacctctgacaaccactgatcatctgtataccatctctacagttttgccttttccaaaatgttgcataaataggatagtgaagtatatagactttccaactggcttctttcacttggcaatatatattttacatttagccatgtctttgcatagcttgatagctcattcctgttttatcgctgaatagaattctattatatggatgtaccacagtttgtttattcattcacctattaagtgacatcttggttgcttctaattttggtgattatgagtaaggctgctataaacatttgtgtgcagatttttgtgtaatcgtaagtttcaaatcagttgggtaaatacaaaggagtgtgattgctggatcatatggtaaaactatgtttaactttgtaagaactgccaaactgtcttccaaagtggctaaccatttttgcaatctcaccagcagtgaatgagggttcctgttactatgctttcttgccagcaattgatattatcagtttttgaatttcagcctttctaatgagtgtctaatgatatttcatttttgtcttaatttttatttcactaatgacaaccttgcccacctttgagtggttataaactatgaatttttaaacaatagttttagttttactaattctctctttgttagaattgagggaacaatgctttcaaagtgttaggctttttatttatattagaaaaaggtttaaaattcaggctgctacctttttataaatgtgtcgatttgtgcttctgtactaattagctacaacgtaggcaaaggaagcatccactaaagtgaatgctaagtcaccagtggcagacagtgaatcacaagaaccttattggattgttgtgcacaaagtagagggagttttgttggtaagcaagatgcctataagattattgtttttctggatgtatccgggacttcattttattcttttttattcttccctctctcattaccatcaccacacacacacacctttctgtcctccccacctaaacatggaaacagcagtaaggaggactaaaatgtaatcagaatatatatgcagcatgactttttcttgctttaggaccagataaccatagtgactttcttttttcctattccaatgtgactagcggataaatgatttctttcacaactgttagttgtatctgattttgatggcctttcttaaaattttactttaagttcctgaatacatgtgcagaacatgcaggtttgttacataggtatacatgtgtcatggtggtttgctgcacctattgactcgtcctctaagtcccgtccccttgccccccacccccaaacaagccctggtgtgtgttgttcacctccctgtgtccatgtgttcttattgttcaactcccacttatgagtgagaacatgaggtgtttggttttctgttcctgtgttagtttgctgagatgatggcttccagcttcatccaagtcccttcaaaggacatgatctcattcctttttatggctgcgtagtattccatggtgtatatgtgccacattttctttatccactctatcattgataggcatttgggttggttccatgactttgctattgtaaatagtgctgcaataaacatacatgtgcatgtgtctttaaatcagtagaatgatttatttagatgatttatttgtagtagaatgatttattcctttgggtatatatccagtaatgagattgttgggtcaaatggtatttttggttctagatccttgaggaactgccatactgtcttccacaatggttgaactaatttacattcccaccaacagtgtaaaagcattcctatttctccacagcctcgccatcatctattgtttcctgactttttaataattgccattctgactggcatgagatcgtatctcattgtggttttaatttgcatttctctaattatcagtgatgttgagctttttttcatatgtttgttggctatgtaaatgtcttcttttgagaattgtctgttcatatcgtttgcccactttctgattggggttgtttttttcttgcaaatttcagttccttgtaaattctggatattagacctttgtcagatgggtagatcgcaaaagttttctcccattctgtaggttgcctgttcattctgatgatactttgttttgctgtgcagaagctctttagtttaattagatcccgtttgtcaattttggcttttgttgcaattgcttttggcattttcgtcatgaagtctttgcccatgcctgtgtcctgaatggtattgcctaggttttcttctagggtttttatggttctgggttttacatgtaagtccttaatccatcttgagttaatttttgtatgtggtgtagggaaggggtccagtttcaaatttctgcatgtggctggacagaactctcaacacaatttattaaatagggagtcattttcccattgcctctttttgtcaggcttgtcgacaatcagatggttgtagatgtgtggtgttacttctgaggtctctgttctcttccattggtctatatgtctgttttggtaccagtaccgtgctgttttggttactgtagccttgtagtatagtttgaagtcaggtaatgtgatgcctccagctttgttctttttacttaggattgtcttggctatacagggttgtctttgattccacatgaaatttaaagtagttttttctaattctgtgaggaatgtcaatggtagtttgatggaaataacattgaatctataaattactttgggcagtatggccattttcatgatactgattcttcctatccttgaggatggaatgtttttccaattgtttgtgtcctcccttatttccttgaacagtggtttgtaacaagttcttcttgaagaggtccttcaaatcccttgttagctctattcctgggtattttattctctttgtagtgattgtgaatgggagttcactcgtgatttggctctctgttgtctatttttggtgtaagggaatgcttgtgatttttgcacattgattttgtattctgagactttgctgaagttgcttatcagtttaaggagtttgggggctgagacaatggggttttctaaatataaaatcatgttgtctgcaaacagagacaatctgacttcctctcttcttatttgaatacccttatttctttctcttgcctgattgccctggccacaacttccaagactatgttgaatcagagtggtaagagagggcatccttgtcctgtgctggttttcaaagggaatgtgtccagcttttgcccattgaatatgatattggctgtgggtttgtcataaatagctcttattattttgacatatgttccatcaatacttagtttattgagagtttttaacatgaagggatgttgaattttatcaaaggccttttctgcatctattgagataatcatgtggtttttgtctttggttctgtttatgtgatggattacatttattgatttgcatatgttgaaccagctttgcattccaggaatgaagcaaacttgatcttggtggataagttttttgatgtgctgctggattcagtttgccagtgtttttattgaggatttttgcatcaatattcatcaggaatattggcctgaagttttctgtttttgttgtgtctcttcccagttttggtatcaggatgatgctggcttcataaaatgagttagggagtagttcctccttttcaatttggaatagtttcagaaggaatggtaccagcttctctttgtacctctggtagaatttggctgtgaatccatctggtcctgggctttttttttttttttggttggtagtctattaattactgcctcaattttagaacttattattggtctattcagggattcgatttcttcctggtttagtcttgggagggtgtatatgtgtccaggaatttatccatttcttctagattttctagtttatttgcatagagatttttatattattctctgatggtagtttgtatttctgtggggtcagtggtgatatccccattattattttttattgtgtccacttaattctgtcttttcttctttattagtctagctagtggtctattttgttaattttttcaaaaactcagctcctggattcattgatttttttttggagggttttttgtgtatctgtcctcttcaattctgctctgatcttagttatttcttgtcttctgctagcttttggattagtttgctcttgcctctctagctcttttaattgtgatgttagggtgtcgatttgagatctctctagctttctgatgttggcatttagtgctataaatttccctcttaacactgctttagctgtgtcccagagattctggtacattgtctctttgttctcattggtttcaaagaacttcttgatttctgctttaatttcatcatttacccaggagtcattcaggagcaggttgttcaatttccatgtaattgtgtggttttcagtgagtttcttaatcctgagtcctaatttgattgcactgtggtctgagagactgtttgttacgatgtcagttcttttgcatttgctgagaagtgttttacttccaattatgtggtctattttagactaagtgccatgtggcactgagaagaatgtatattttgttgatttggggtgaagaattctgtagatgtctattaggtccacttgttccagaactgagttcaagtcctgaatattcttgttaatttttatctcattgatctgtctaatattgacagtggggtgttaaagtctcccacgattattgtgtgggagtctaagtctcttcgaaggtctctaagaacttgttttatgaatctgggtactcctgtattgggtgcatatatatttagaatagttagctattgttgcattgttgcctttaccgttttgtaatacccttctttgtcttttttgatctttgtttttttaaagtctgttttgtcagagactaggattgcaacccctgctttttttgctttccatttgcttggaaaattttcctccatccctttgttttgagtctatgtgtgtctttgcacatgagatgggtctcccgaatacggcacaccaatgggtcttgactctttatccaatttaccagtctgtgtcttttaattgggccatttagcccatttacatttaaggttagtattgttatgtgtgaatttgatcctgtcatcatgatgctatctggttattgtgcacactaattgatgcagtttcttcatagtgtcattggtctttatattttggtgtgtttttgcagtggctggtactggtttttcctttccatatttagtgcttctttcaggagctcttgcaaggcaggctggcaataacaaaatccctcagcatttgcttgtctggaaaggattttatttctcctttgcttatgaagcttagtttggctggatatgaaattctgggttgaaaattcttttctaagaatgttgaatattggcccccaatctcttctggcttgtagagtttctgctgagatgtccactgttagtctgatgggcttccctttgtaggtgacctagcctttctctctggctgcccttaacactttttccttcatttcaaccttggagaatctgatggttatgtgtcttggggttgatcttctcatggagtatcttagtggtgccctctgtatttcctgaatttgcatgttggcctgtcttgctaggttggggaagttctcctggattatatcctgaagtgtgttttccagctttttgattgccttttaacactaatttaggtccttcctctctgagtatacctggtgctaccatgttgccccatctctccccaagctgcaaacttgtctttctccctttgtttccaattccatcttacccattctatatgccattacttcagggtcacactaggtaaaaaacaataatagtaattgtctaaatcaattttattttaaatgttaggggggaagaatacaactaacattaattgaacatctacaatgcaccaagcacttttatacatgttctcatttaattctcacaacaatcccatggtgattgttatttctgttgtatagatgccattaatttagaggtaagtggcatgctttaacccttttgtacatactattccgtctgtctaggataccccttcagttccatctctatcgagcaaactaccaaaccttcaaaagccacttcagatgtcatctccctagctggtggtctcagcactgcccatgtcaattctgaaaagactctccaagtaattctgatactggcccctggttaagagtcatcatatgaaacaatactgtgtaaagagcaagagccacgtcttactgatatttgtattcctgttgcattgcagagtctattttgcattccacagtagtattttggtcagtgtttattgaaggaattatttgaggtttatggaaatgcccatgttatgttgtatgttactgggggtgggtagattttgaaaaattcaagtaaatgtattcagataaatgctacatctctggggagcagtagaagtgaaaggtggtgataactatgaatgaaacccatataaacacagaggcaacaatttttagaaagaagagaatgcttatcatatttttattctttttggaaacaaactacttctctcataatgcaaactaaaaaaagtaaaatttgataaagtctgtttggctggtacaaatacacagcacataattgtaaaccagggatatttccttgggaaacggattgccatcagaaaaagagactgcatgaaatgtttaacatttattaaagtggcataggttaaagtgttaaatagctgaaaaacactgaagtaggaactcatagaaaagtttgggtagcctactatcctttataaaaagcagggtctttgttgattcaaaatacttggttgccttgggctctatggtattgaatgttgctaaaaataaatgcgccacctacttgcacttagaaatttcttcattctataaaagtttacattgtgttgtaacagaatttgacctttattggcaagaaataatgtaaaacatttctaatcaattctcaagcatgatatggcagcactttccacacaactaggtaccagctgataagagatgagatctctgattactatttcagcagttaccattagtacaagtaaaaatgaatattgtgactggcaagtgctcaaggattttagtactaacataattatttattgcttagaacttggctctgcatggtccaagttcaatgtcaatttaagaccccagcaagatactgtacagctgacttcatttgccaaagaaatttgaaaacttttttaaagctattaaaagcattcttgctgttttttggcagtgctaggtagaacttggctcatcatggagctgggataatcacagagtgagcgaatgataatttaggtccttaggcaaacatacaagctttgaagcctgggtatttctaattgcatgcctagtacctgattgacatgattctgaggttaaacaactaccctgagaagctgctcctagttgccgattgtttaccagtgaccttccactcctacacatagaattgtgtttcacctactgacagtggtctgccaaagtccaggatgaatcttcctggagtgtagattctgctcagggttaacagaaaacacttcacttcattctatttttgtgtgtgtgtgtgtgtgtgtgtgtgtgtgtgtgtgtgtgtgtgtgtgatgtataatgcaaaattcttctaaaatgggagacttcaaagaaatgttaggacttaagcctgtccctcccactcctgccatggggagacggcatttggaagtgtggagaatcttaaaaacactgctctaagttatggccacttttctggaatgctgttatctctcacctctgcccagaagtatcctgcttatttttcaaaagtcattgtccccatcttctgtaccccaagcagagttaacacttctctgcggctccgtagactttcctttatgaacctcatatggcattcatcccattgttgtgattgcctgtttgtcttctcactaggtaggtggtgagcctcagaagaacaaggtctacaggttctttatatcctcagtgccttgcactgtatttgactagagcaagtaactagcaaacagtgaatagtgaataggtagatggataactggatgatagaacagacaggaaaatgtccattgatatgtccacccacgtgaataagattctgagctcctctcctaatattctagtttaggcctctgaatatagaaatgggtgttcactgggctgttttcaacttgcatatcagttatacccttacttttaatggggaaatatcaatgtaattcattctattaaggctcaggaagaaaaatcatatgatcatatcaattaatgaaaacaaagtatttaacaaaatccaataccaattcatgatttaaaaaaaaaaagaaactcccaaccaactaggagtagaggggaacatccacaaattgataaaggacatctacaaaagttctacaggtaacatcatactttatggtgaaagactaaatgcttttcttctaaaatcaggaacaagattaagatgtctgctctcatcatttctagtcaacattgtgctggaggttctagccagtgaaataaggaagcaataaataagaggcaaccaatttagaaaggaaataaaactgtctttatacacagacgacatgattatctttgtaaaaagttgtaagaaatccacaaaacaactaccagaactagtaagtgaatacagcaagttcacaggatacagggtcattattaaaaatcaattctattcctatatactaggaataaacaatcagaaattgaaaattttaagaataccattcttaatagcatcaaaaatatgaaatattaagatgtcagttttcccaaaattgatctatagattcaatgcaatttaaattttttataggaactgataagctgatctgaaaatttatgtggaaagtctgagtacctagaatatcctaaacaactttgaaaaaagaacaaagttggaggacctatgctacctgatttcaaggcttattagaaagctacagtacatagtgtttttaatatagacagtagatctggttgcagaatagtgagccaagaaataaacccacacatatatggtcaaatgatctgcaacaaaagtgtgaagcaattcaatggaaaaattatatttaaaagacaaaatacagcatggaagaaaatatttgcaaatcacttatctgataaagaactgttatcaagaatatataatgatcttttaaaaaatcaataataaaaagcacacaactcaatacttttaaatggaagaaagagagtcagggacaatggtggatatctgtaatcccaactacttgggaggctgaggtaacaagatcacttgagcccagtttgaaaccagcctgggcaacatagccagatcttgtctctaaaaacaaataaacaaaaaatttaaatgggtgaagtatttgaaaagacacttcactaaagaagatatatgaaaagatcctcaacatcattagccatcagagaaatgcaaattaaagccataatgagagactactacatacctattagaataattaaacttaaaaagactgaccataccaagttttgatgaggatatgagaacctgaaactctcatacacactgctggtgggaatgtaaaatggtacatccactttaggaaatagtttggcagtttcttataacatgtacttaccacatagtatatgttacccaacagttctactccaaggtatttcctaagagaaataaaagcgtatgtccacacaaagacttgcacaccaatgtctgtaacagttttatttgtagtaactaaaaactggaaacaaatcattttgtccctcaacagatagtggataaacaaactctgttacatccatgcaacagaatactacttatcaatgaaaaggaatgaactgatacatattataacgttagaatctcaaactaattatgctgagagaaagaagcccgacaaagtatcttgtgtgatgctatttatataaaattctagaaaatgaaaactgatctatagtggcaaaaagcagatcagtcgttacctggaaatgcagagggcatcagagactgggctgagtgggaagggattacaaaggatcatgaggaaacttttgggggtgatggatatccttgttattttgattgtgatgatggtttcacaggtgtacatagatgtacatacatatgtaaaaacttaaatatgtacaatttgttgtatgtctataaagccgtaaaaatgatctctgtggctgaaaatgaagctggttataacttaatctggagtgtgtttcaggtatcagtgggttataagagaaaggatatagataggctttgaggctggagttaaagaggcaggttaaataatagagacgggctattctttagttggcttcttgccagaacgctttttcagataaaggttctgagagactgatttaaatttagtaatggcaaaggaagatttctgttccaaggttactaattggtttttaaattgccatatgattatttttatatcttatgagtaatacatgcacatagtttttaaaaatatgaactaagtacctaaaagtttataatgcagacaatgtttcactgttccaaccctccgaatcctaatcctctgagattacctttcactctattaactgtttctgtttagttcttctattgactgcttccatatatactgctatttcttaattcatctattttacgctttattaactttgtaatttaataaatgaggctataactcacttatactatctcttgtcccaatttagttatgatgctttttagttcctcttctttttttttttgaggaatatacttagacctttatttcttgtttcgtaaactatagacagtatctcttagttctttgtaaaaactaagagtttgtaaaaagaggccattagttccctttatctctctcccctacctgccaattctagtcatgtgtacttttactttttacattgccaagagtggtaatgtttatgttttgctctacatttataattaactatctctataattaaatatcctgtgcttttatatattggttatttccagaagttgaaaatcaatatacagtgtttgtactattgttaattatttaaaatttttctctcttctgtcaagtgttgatagtattacatttcttaatttgtaaaacttgtttttttctggattttctaattacctttattttttcttgcatcgtctgctacattcataagtttctctaatttcttaaagatggataggcctggcgtggtggctcacgcctataatcccagcactttgggaggccgaggcgggcagatcatgaggtcaggagttcgagaccagcctggccaacatggtgaaacaccgtctctactaaaaatacaaaaaattagctgggtatggtggtgcctgtaatcccagatactcaggaggctgaggcaggagaatcgcttgaacccgggaggcagaggttgcagtgagctgaaatcgtaccactgcactccagcccagctgacagtgagagagaccatctcaaaaaaaaaaaatggataaaatggtgaatccttttccctgtctttttcttgatgcctctctcttggagccccccttccttccattcagacgaagtgttccttaggcctctactgtatggctgggacttacttttattagtctttgcaatattaaaatgtcatgtttttgttatcagactcaactgatagttggttaggacaaaattataggtttgaaataattttctgtcataattttgaaggcattcctccattgttctctctaagagccagcgttgctgatgagatgaccaagccattccaattcttgttcccttaactattaatgtttttcctctctgggagcttttaggatcttttctatatctttgctgttctgaaatttcataatgtgtgtaggggttgagcaaaatggtttagtaccccagatataaggcctgcacctcaataagccccaactatgtaaatagagccattatactgggggacctctaaattccagatagtagaggtctttgttttacagcattaatgcccacattagttacttcaattcttcttagacaatttattcaatctctttagagaagaaccttctgatttttttctttgccttgggaatcaatgcctgaatactagcagttctatatgcagtggaggaaaatgattaatatacagattttcaatgaatttctcatatttcattttcaccctctgccttacttgacatttccaattttcaaacttttctgtgatcctacagggcagaccaacatcctcccaagctgtaagccccctctgtcattttatctgccaatctttatcagccagcatcctattcaatgtctgtctatcagaaatgtattgggatctcttttctgctgactccctctactattgtcttcattatatcttttttattgtttaatgtcattgttaaatttttttatttttaatttttgtgagtacatagtaggtatatatatatttatgggttacacgagatattttgatacaggcacacaatgtgtaataatcacaacaaggtaaatgcagtaaccatcacttcaagcatgtatcccttctttgtattgcaaacaatccaattatactcttagttttttaaaatgtacaatattttaaaacgtacaataataaaatgtacaatgattgttgactgtagtcaccttgttatgctatcaaatactagatcttattcattctatctaactatattttttaccctttaataatccctactcccccacccattactacccttcccagcctctgataaccatcattctactctacatccccacgagttcagttgtctttattgtttagctcccacaaatgtgtgagaatatatgaagtttgtctgacttctttcaattaacgtcacgacctccatttccctccatgttgttgcaaatgacagtatctcattctttttatggataaatagtactgcattgtgtatgtgtaccatatcttctttatccattcatctgttgatagatacttaggttgcttccaaatcttggctattgtgaatagtggcacaataaacatgggagtgtagacatctctttgatataccgatgtcctttcttttgggtatatacctagcagtaggattgctggatcatatatggtagttctatttttagttttttgaggaacctccaaactgttctccacagtgattataataatttacattcccaccaacagtgtacaagggttccctattctccacatcctcatcagcatgtgttattgcccgtctttttttataagaaaacatttttgaagcctttatttacaaaagctttaaaaacaagtaataccctctgttttgaaaataatgttttgtttaaaaaggaccacccagttacagcactgtaatatcatgagtaaagaatgtacaagggagacaaaccaatgtgactaacatttggagatttgctaatattattgattgaagtataggtaatacacattataacttgtagtcaatcatttcagggtagggttaatgattaccgaaaagtcttcctacatcctacacatgctctggtctggtcacatattctgcatggctaaatatttcacagtctcttttgtcaatatatgtaaaatagattgcaaagatatacacaaaaaaaacaagcattacactcctcaggtaattttattagctctctctctctatatgacaatatatatatattctcatatattctcaagcatcaaaatgttatacttgactgaagatttgtttcagaaaatattttatcctttatttatgtactcatatatatatgagtacattatatatatattatatatatacatttatatatggattttgttttgtaccaaatctctccattatttacctttgtagcaactaggaaagcacaatttttgacttctaatttaatttggtacaaaatatacctaaagacttgttatctttggattttaaaaaaaatcaatttgtataaccaacaaatcaagagcatcataagtatggctacgaaattaaaaaaacaagggtaaacagtgatggaataaaaataagcagatcaagggaagtgtgctatcataaagtaactgtagcttcaacatcttgagtaccagtttcctggcagatactaagtattcaatcacaaggaatttttcctgaagggggtaagactggtttgaaaagtcttcagtcacagagcagcctacacatgccaattaaaaactgacagacactagatgtgcttggaagattaaacattatgtacagaaacagcagttactaagctcctcagtagtttcttgtcttttttttagtttcactgaattgacagtttgcacaataaatgtgctacattctgtgggtcaaaaccgagtaaatgctgtgtaaagttggtagatggtcatttttccagctaagatcaagtaaaaacaacatttctgataaaacagaggttttgagttagaatcactctccaaagtacaaaactgatggtccacaatctcaaatagctaaaactcctgcagaatggaagggagagacatgaaacagagaaataaattacagtcagtgctagttaatttaggaaaagggagaaataaaccaaactcccaagtaggtaaagtttatcaaaatattcaatgatgtagctttctccactctgtcacacacgcttgctaacaagtatattaaattaaggccaaatttaacctaaatgtgtttttttgttgttgttgtttgtttgttcttttgtgggtttttttgttttctttttttaatctgagataggaacgatcatacttagtactgaaaggcagacaataaaatgggccatgaaagggcggggggaagggactgtctgttgttcaaaggattcaaccagagataaaacctatatacaagcatgtgtgtagctcaaaataaaataaaaataaaaggactatttcatgtcatgactgcttgttggcttcttcttcatatgcattccctgtgccattctgtacataggatgaaccagaaccaaggccatacaaatgaccacaatatttggcatcatcagtatgatcttcaaagaacattcctctcattttgaaaaaggccattcctgtcagcaatgatttagatcctgcctgatgtggtggtcctatctatgccagctctaactgttctgccacctcctgtaatccatctttgagatgtttgcagctcttcatgaggtacttcacatcataaatgacaggtaaaaacaatcgaaggatctcaaagaagtcaagttcttcttcaggcaagttagagttggtcagcattttgattaaatagccaaagttgtaactgctgtgaaatgacaaccatttgaccccttcacagaggaccactcctgaagtcataagaagttctgcaaagtactgggtctcaattccttcctcatcatgttttttaaactggataccagatgttgttagtagctctatagagttctgggcatacatgtcctctgtcaaattaaatttaaaattaaactgccaagttgaagttcctggagggtattctccttgctcatttataaatgtcagtcctagctgaattatctttaacaagtctacattacaccgcaatagttggtattgatagtcagcattgctcctgaatcctccagtgggtcttgcaaccacacctggaaactcggtgtccatagcaacgtaattatattttcggataacttgatgaattttcttcatctcttcatccacgttgcaagcccaaacttcacaaattctttggctatgatgtacagttgctgctggcatagtgagggcacaagggagtctagatgccaagcatcaaaatgttatacttgattgaagatttgtttcagagaatattttgtcctttatttatgtacttgtgtcactgagctctcactcctcctcctccccctggccatagagacagcacccggcggcagtggcagtggcgggtgccccatagacacctctcgcccagcaagggatctgcaccacaccgtggtgcgctgtcacttttcgcaccgcctgtcttttgaataaaagttaaaatggataaaggccattttcactggggtgagatgatatctcattgtagtttcaatttgcatttctctgatgatagatgatgttgagtaccttttaatatgcttctttgccatttgtatgtcttcttttgagaaatgtctattcagatcttttgctcattttaaaatcgaattattagattttttttcctatgaagtggtttgagctccttatatattctggttattaatctctgtcagatgagtactttgcaaatattttctcccattctgtggattatctcttaactttgtggattgtttcctttgctatgtagaagtttttaatttgatatgctcccatttgtccatttttactttggttgcctgtgcttgtgggatattaaatttttgcccagtccaatttcctggagttccctcaatttttttctattagtgtcatagtttgaggtcctagatttaagtctttaatccattttaattttatctttgtttacagtgagagataggagtctagtttcattcttttgcaaatggatatccagttttcccagcaccatttactgaagagactgtcttttccaaatgtatgttcttggaacctttatcaaacatgagttcactgtagatgtatggatttattccagggttctgtattctgttccatagtctatgtgtctcttttaatgctagtaccatgctgtttgggttgctatagctctgtattacaatttgaagtcaggtgatgtgattcttccagttttgttctttttgctcaggatagctttggctattctgggtcttttgtggttccatatacattttagaattttttttatttccatgaagaatgtcattgatattttgatagggattgcattgaatcagtagatagcttggggtactatgaatatttaacaatattgatttttctaatccatgaacatggactatcttttccattttttgtgtgtcctcttcaatttcttacgtcaatgttttatagttttcaatgtagagatatttcacttctttggttaagtttattcctaggtattgtattttatttgtggctattttaatgggattactttcttaatttctttttcagattgtttgctgctgacatatagaaatgctgtgttgatttttttttatcctgaaacgttactgaacttgtttatcagttctaattgtttttttggtggagtctttagttttttccacatataagatcatttcatctgcaaataaagataattcaactttgtcctttccaatttggatgccctttatatctttctctcatccaattgctctagccaggacttccagtactgtcttgaataacagtggtgaaagtgggcatctttgtcttattccagatcttggagaaaaggcttccagtttttccctattgcgtatgatactaactgtgggtctgttatatatggcttttattgtattgaggtatgttccttctatacccagtttgttgagggtttttatcatgaacagatgttgaattttatcaaactcttttttcagcatcaattgaaatgatcatatcatttttgtccttcattctgttgatatgatgtatcacattgattgacttgcatatgttgaaccatccttgcattcctgggataaatcccactttgtcacagtgagtgatctctttaatgtgtcgttgaattcagtttgctagtattttgttgaggatttttgtatcaatgtttatcagggatattggcttgtagttttctttttttgatgtgtttttgtctggttttggtatcagggtaatactggccttatagaatgagtgtggaagtactccctcattctctattttttggaatactttgagtaggattgatattagttcttttttaaatgtttgataaaattcagcagtgaagcaattgggtcccaggcttttctttgctgagagatgttttattacaacttcaatctcattatttgttattagtctgttcaggtgatggatttcatcatggttcaatcttggtaggttgtatgtgtctaggaatttaccagtttcttctagatttttcaatttattggcatacagttgttcataatagcctataatgatcttttgtatttcttcagtgtcagttataatgtctcctttttcatctctaattttattactttaggtcttctctctttttgtagttagttgggctaaaggtttgttgatttttttatcttttgataaaaaaacttttcattttattgatcttttgtatttttatttcaaatttctactctaatcattattatttcttttcttctaattttgagtttgcttcggtcttgcatttctgtttcttttttaacttttgtgagtacatagtaggtgtatatatttgtgagttacaggaggtattttgatacaggcatgcagtgcataataatcacatcatgataaatgaggtatccatttcctcaaacatttatcccttgtgttacaaataatacaattatactattttagttagttttcaatgtacaattaaatgcaattctagttctttaagatacatcattaggttgttcatttgaaatttttctagttttttattgtaggtgcttattgttataaactttcctcttagtactgctttcactgtatcccataggttcttgtatgttgtgtttccattttcatttgctgcaagaaattttttaatttccttcttagtttcttcattggcccactggtcattcaggagtatattgtttaatttccatgtgtttgtataatgtccaaaattcctcgttattgatttctagttttattccatcatggtcagggaagatacttgatattatttcaagtttttgaatgttttaagacttctcttgtggcctaacatatggtctatccttgagaatgatccatgtgctgagaagaagaatatgtactttgcaacccttggatgaaatgttacgtgaatatccattaggtccatttggtctatagtgcagattaagtctgatgcttctttgttcattttctgtctggatgatgtatccaatgctgaaagtgaagtgttgaagtctccatctattattgtgttggggtctatctctctctttaactctaataacatttgttttatatatctgggtcttccagtgttgggtgcatatatacatatatttaaaattgttatatcctcttgttgaattgacccctttatcattatataatgaccttctttgtctcttttatagcttttgtcttgaaatatattttgtctgatagaagtatagctattcctgctaatttttttgtttccattagcatggaatatcttttcccatccctttattttcagtctatgtttgtctttatacatgaagtgcatttcttgtaggcaacagatcattgggtcttgattttttatccacttagccactctatgttttttgattgaagattttagtccatttacactcaatgttattattgataagtaaagatttactcctgccattttattacttgttttatatttttgtggtcttctcttccttctttcctttcttcctgtcttccttctagtgaaggtgattttctctgatggtatgatttaatttcttgattttgattttttgtgtatctgttgtacttttttatttaagattaccactatggttgcaaataatatcttataaccatttattttaaactgatggcaacttaacaatgattacatatacaaacaaactaacaagcaaagagaaaacgaatagacactctacactttaacttcatccccccactttaaaaccttcttttctatttatatcttattatattgtctatgtcttgaaaagttgtcatagttattattttttattggttcttcatttagtctttctacttaggataagagttatttacacaccagagttacaatgttataatattctgtgttttcctgtatacttactattaccagtgagtttcgtatgtgcaggtgattatttattacttattaatgttcttttctttctgattgaagtactccctttagcattttttgtaggacaggcctggtgttgaaatccctcagcttttgtttgtctgggaaagtctttatctctccttcatgtttgaaggatattttcactgaatatactattctagggtaaaaggtgtttttttttccttcagcactttaaatatgtcatgccactctcttctagcctgtagggtttccactgagaagtctgctgccagatgtatacagctccattgttatgttatttgtttcttttctcttgctgctttcaggatcctttctttatccttcacctttaggagtttgataattaaatgctatgaggtagtcttttttgggttaaatctgcttggtattctataaccttcttatacttgaatatggatacctttctccaggtttgggatgttctctgttatccctttgaagaaagtttctgccctgatctctctctatctcttctttaaggcaaataactcttgtatttgcccttttgaggctattttctagatcttataggcatgcttcatttttttgtattcttttttcttttgtctcctctgactgtgtattttcaaatagcctgtcttcaggcttactaatttttgcttctgcttgatcaattctgctagtaagagactctgatgcattcttcagtatgccaattgcatttttcagctccagaatttcttctttattcttttgtttcaatctctttgttaaatttatctgataggattctgaatttcttctctgtgttagcttggatttcattgagcttcctcaaaacagctatgttgaattctctgagaagtcacatatctcattttctccaggattggtcaccaatgccttatttagttcatttggtaaggtcttgatgcttgtggatattcatcgatgtctgggcattgaacagttacgtattgactagtctccgcagtctaggtttatttgaacccatccttcttgggagggctttccaggtatttgaagggacttgagtgttgtgatctaagtctttggtcactgcagctttagggccaccccaagcccaataatgctgtggctcttgcagactcatagaggtaccacctggtggtcatgggtaagatctgggagaattccctgaattgccatacagagactcttgctctcttcccttactttcccccaaacagagtctctgtctctatgctgagctgtctgaggctaggagaggggtgacacaaagcaccactgtggccaccaccacctggactgtgctgggtcagacccaaagccaagatagcactgagtctcaccccaggcctgtggtaaccactgcctggctactgcctatgttcactgaaggcccaagggctctacaatcagcaggtggcaaatctagccaagcgtacgatattccattcagggtggcaagtctccctggccccagacaggtccaacgatgccatccaggagccagaacatggagtcaggaagcataggaacctacttggtgatctattctactgtggctgagctgacacccaaagtgcaagacaaagtccttcccactcttccttaccctttcctcaagcagaagagtctctccctgtggctaccactgcctcaggcccatggtgagtactgcctggctattgccagtgttcactcaaggcccaagggtctttagtcagcttgtggtgaatgctgccaggcctgggactcttccttcagggcagtgggctcccctctggcccaggacaggtccagaaatgccatccaagagccgaggcctagaatttgggaccccaagaacccacttggtgctctaccccactgtggctgagctaggacctaagctgtaaaacaaagtcccttctactcttccctctccttttgtcaagcaagaggattctctcatagccaccacagttgggaatgtactgggccacacctgaagccagcacagctgaatctcacacaaggcccgtgttgagtactgcctggctaccactgctggtttttcaggggccaaaggctcttcagtcagcaggtgatggattctgtcaggactggatccttcccttcaaggcggcaggttcccttctgacccaggatgtgtttagaaatgtcctccaggagccagggcctggaatgggagccttaggactctgcctggtaccctattctactgtggctgagctggtatccaagttgcaagacaaagtcctctttattctcccctcgcctctcctcaagaagagggaaggaatctctcctggagctgtaagctgcactgcttttggttgagggaggggtgatgcaagcactcccttggcaccccagctgatatatcactagattacgtgcattccaagctgctgtctccaaacccagcacagcaccaggacttgcccaggaattgctgtccttgtggcctagactgcctttaaagtttatttagaaccccaaagcactttagcctacagtattagggcttgccagaactcaggttccaaccactgggatggacagttccaaccactggctagcactggtctaatgctccttccatggttgccagctgagttctgccccaggttgctttccgctgtgacagggcagcactgagtttcaatgcaaagtcacaatcactgtgctctccctccccaaagtgcagattctctctgtgccacatggccactgttgggggatgggtgagaggtggcataggtggttttaagactgtctttcctaccctcttcactgcctctttccttaatatgatgttaaaactaggtactatgatcactcatctgatttttggttcttattaaggtggtttctgtatggatatttgttcaatttgatgttcctgcaaggggaggggatgatcactgaaggctttcatttggccattttgctccacctcctccacctctgtttgtctgtttaatgtcattttaatgggatcttgggagagagaggagctaaaactgtttggttagttaccttgatgcagataactatatacttgttaaattttaaagtttatggagtttctgtggattttttggaaaatatttgtaattaggagcaattagctatgaactggacaaacctacattgtttatccatttatagaaatcaaaggattcgttagagttaaagctctgtgaaagagattagtataaagcattgaaatctaattctccattgcttcatggaaagatatctttagtccctaatactaaatcaaacaatggatatgtataaaattgactctaatgaatagggtattttgctatacttcatttcatttgtttatattttatcctaatttctttttgagtgggttgctccattgagatactatacaaaatattcatgagacaacactcagcatactttcttcactcactttcatggtcacaagcaagagtcaggaattttcctctaagaaaatgacatttccacagacatcctaatgctggattccagtcagtagccatattgaaaaaaattgtctctcaagacatttgtctctcagttttacagccactgaaatagtattggcctgccattacgtcacataatgaattattttgtatttacctgaagggaggccctggacacacctggacacatggggcactaaaatgccaagctagcagagaacagcattgcagctttggatttgtctaatctcacagtggctttgctggtctcgtgtttttcttgccagtccttttatgcccttggtgattctagtgttatagtctttaaaatcctgaatttgtgtcccaggccctttactgtttttcccaatcctcgggtttgtttcaggcttttattatggactaaatccttgctgattaacctgcctgcccctaagatacctgtatcttaaactcttctttgaattcaatctgcgtacttatagcctatcctgcctgaccttttcctctgaagttatttactgatctctgagattcactttctatactcacattcctgtgagccagtcctggattaatggtccactggccacgtatctacattcatatccttgttatctacccaagcccatgagtctatttggaccattgtttctagtctttctttcattatctgagccctagttataacagttgaactctagtctacaatgtatttcaatatcaatgtaaactgaatatcactcatctttccttaaaatttttcccactacttaatttttttataatatttggaacatttttgccttctcagaatcagtagtcatctgtttcttaatttgcttcttatttgtatcctattcccctcccccaagttctgactgttgcaactctgttttcactaactacctcacttttctctttccttcatatttatctagaatgttgtagtcagatgtggcttggggtagtttatgtggtgtaagtctccattggcagcagaatggatttcgtagaatgctattaatagtgaaattttggacaaggagaaaaaaatcctagtttaaatatattgctcaggcaatctcattttagtcataacgctactctaacttgtgctaatccagcttcataaaggtaaactgcaacatcattatcaaatatttaagagccatttaacaattcacaattaagaggttgtgtttgagctaatgttttctgaatccagagctcatttaatttataagctactcacaaatgattgcctttagtgatttccaggtactataagtggaagagtatgtttttctctttatgtgccaaagcacctttcactttagaagcatgaggaattacaaaataaataagcacacactcccaagggaaggcagtgtcatccagtatatattgttgcccttccttttattcaaagatgtcactactgatctaatccactctcatggggagcaaagactaaatcttcaaccagaagtcctttctatatgacatacatacaaaccattttttttatttgtgtctgcagctgctacttgtagagcctgtcactggatgtatttctgtgtttgacttgtggtcagctgaaagcctttgctcaaaaagttcaaaaattccatattgttgcattccaagctggtctctgctgctgttttccccagcagcccacagctatgttaatgttagttagagctattctataatacacctttagagtatttcttatgccacccctgcttatggttatgccataaagctcaccataccaaagatgctttggtttccttctgccattgtatttctacgcatgtcagcaaggaacagtgatttaatgctgatagagaccaactgacttccagaatctcagtagtagtcatcccctcttaccattttacattaagcatgactctgactctgacaataaaacagttcaccaagtagatgtgatatctgtggtgggtgtaaatttcaaagtcatacaaaagctggacccaacttatattttccattgatgaggatcaattcagtaagcttttagtttttcagctctgttctggatgttaggaatcaagctagacctaggaaacaaaaagtcagggcaggggtccattttccccctttgcattaatagttttatgtttctaataactcatctttctccttgatgtacatcttaaatagatttcaccctgtccagaggacaagtccacactggttctggacccacaaatatacctgccattgaggaggcatagcttactacctatgggggaagaaaaaatacaattaagatatataaggcattatttgataaatgtgaggggatctgttctgccccaaaatgggatctaagaaaagccagagattgaactggtctgtagtacaatttcacactggtgccattccatggtaatcttcccaagtaaaaatactttttttattttcctttctactttgtagttacttgcattgttgggcagtgatttttaagtcaaactgcctaggaagcagaattcagtgactgcttttagctctatgtgatgaaaaaatgttggttgtgtttagattccacatttagcgttactccgtaatttcagtcatcctctgacatatctacaacaagacatggcaatccctggcactcacatcagagatgtccaagatgccagtttcatttggcatttggcctgattgctgccaccaccacccccaccccactggtgacagctcccatgggatgctatgatcaatgttgaatgtccttgtttgcttactcccaggagttggcacactctgttcagcaactagcacatactgtgcttctattgttgtcacactgtttttgaaaccttactacctcctattgtgtagtgctgtcacagctacaaaaaaaccacaaaattgtttgtatgttgtttgtctatgtatattaaagatagattctagttcagtgccttccatatggtaagtactcaatgtttattcagacaacaccaccctgaatgaccttctctagaccttttgttgataatcaaagcatgtcgagttaagggttcttatgattaaaagtgcgttcaatgccatcttttgtaatcattttatatctatgacatatctatcatggatatgtaccaatgagacaaccctgtttcactcattggtgccaggatgcttatatcttgctatagtgaaatcagagattttcttgaatgtttcagggcataaatggtttaatttatttgaaggtcccagctgataggtcatggatgatgatagtgatggcagtggttgcaataagaaaaatagattttatattcaacaacatgaaagagaaatcattttgaaaaataatagatgatttgctgattttacagagcctggtatgtacctgcctcctcttgaggggcatgaagtaccaatttcataaatacattaactctgggaatgatagaagaaaaggtgaaaaacattagctatgcaagacccctattttacccagaagaaaaaagaggactttgtttttttagtctaaaggtaatgaaccgattgataaatgaacaatacagctgtttctcaaagtttagttcaaggattgggtgcacccctagtgagcaagttgaaaagtcagattctagggttccacctcagactgactttaaatttgggaagggtaaggcctaggattctgcattttgacactcatgcctagtgattctgatgtacactgaagtttgagaaccactgacctatagggttctcattcttaggatccttttgacttgattcctgccaatagtgtattgaatccttagtgtactctccatgatggatctcaaaaactaggcccaattagagtcaaaaaaaaatcttggctttaaggaatggattggtgatagtccgctctctggtttaagtatgtcccctccaaaatgtaggtgttgccaatgtggtggtattaagaggtgaggcctttaagaggcaattaggccattatggctcctaccttgtgaatgggtttaaggtcattttaaaagtggctttacgctatttaataaatggtgctgggaaaactggctagccatatgtagaaactgaaattggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgacataccatctcacaccagttagaatggcaatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaattgaacaatgagaacacatggacacaggaaggggaacatcacactctggggcctgttgtggggtggggggaggggggagggatagcattgggagatatacctaatggtagatgacgagttagtgggtgcagcacaccaacatggcacatgtatacatatgtaactaacctgcacattgtgcacatggaccctaaaacttaaagtataataataataaataaaaaaagaaaaaaaaagatatgaaagtctcttatcaccaggctcaaacaaataaagatcctcaataaagaaaaataaaaaaaaataaaaaataaaagtggctttacgcagtattcagctctctcgcccttctgccttccatcatgtgagtacacagtgttcctcccctctagaggatgcagcaacaagatgccatcttggaagcagagagtagcccccacttcataatcaaacctgttggcaccttgatcttggaatttctagctcccagaactgtgagaaaataaatttctcttctttataagataccgaatctctggtatttcattataacaacatgaacaaagacaatctaattattctttcaagagagtgagatttattagggcctattatgtgccaggcccagggctaggcactagctatacaaaaatggatgtgtgatcccttccctaaagaggcttatgagtaattttctatgaattatctagtaaaatcaaggacattagccatgaaatagaaaatgaattaaatttactctatgtcatggtaccaaaaaagtaccaaataattttgtgggtttagatatataaaaaatatgtttgtagaagtgtctggagagtcactagcaataatggatgtatccctcatgtctcactatgaacgaactgtttccagctgagatccctgtaatttgcaggtgctgtttaccatgtaattttaccctaggaaacaagggtgtaatcacttaataaagtgtaaagaattagatttttttcccccttgagcaaaatgcctggctgtggccaacattcctgatgcttcctcccttgtgcaataggaaagcaatattctaaaagagaagactgttttattcatatcctgcaacttgcctctggaggctatgctaatgaatgcaaaactcaagctggaattccagatattttgtgtgagcagccactgatttttgtctttaccattatacagaggatagttttccctgctacctgtaactgagatgcaaaaaagggccctgtgaatagggactctctcattttaagcagtgtttttgtgttgttttcttcttatttttattgaaaaaatagaaaccatgtgtattagtccattttcattctgctgataaaggcatacctaagactgggcaatttaaaaaagaaagaagtttaattggacttacagttctccgtggctggggaagcctcacaatcatgggggaaggcaaggaagagcaagtcacgtcttacatggatggcagcaggcgaagagagagagcttgtgcaggggaagtcctttttttaaagccatcagatctcatgaaacttattcactaattacaagaacagcagggaaagacttgctcccatgatttagttgcctcccaccaggtccctcccacaacacatgggaattaatcatgagatctgagtggggacacagccaaaccatgaactatgttcaaagcattttcatatacaggcaggcagttctcttctaatgaacacttgacttatgaatgtcccatattcatcaacaacctctcttgagggactttgaactactcttactactcatggaaggtggagttgtttctgctgtctgcagaagtttgtttctccctcaactctcctcttctgggggcttgagttctcacaagctcctattagacccttagaacagttaatacaagagtatcttttcctaatgccaccactaggatgcaggaaggtgctagggcccctgccagaactcccataggagctcagcccatgagggagcacaacaagtatgagggaatctctggaattgtagttggtaatggcggggaggttcttcatctgcatttcaaaatatcttttcctagaaatagcattgtgctgaatagcctacccttgtagaacttgggtgtatgatagattcaccaatctagaccacagccagaaatcaagcagtaaacaaatggtttctaagccactagaaaatatgcatcttacttattggaaaagccgttcaaaaccacactcattgcctgtttattctgtttgtacataagtcttattagttttaactaaatgtcaagcctatagcagattataagcagcaaatctgaaaggactggaaaagatgttacaggtaggtaaagtgaaatctgatagttgatggcaagacaaaagataaaataacattaaaaagaagtttaagcactcaaaaaccaatcacaatgaaacagtacttcacatccaccagaatggtggattgattaaaaatactgacagtaccaaccgttggtgaagatgcagagcactgggaccctttatgttgttggtgggcatttaaaatggtagtcactctggaaaatagtttggcagtttcttacaacaaataccatataacccagaggttctactcctaggtgtttacccaagaaacatgaaaatataggtctacacaaagacttgtacatgaatgttaatattagctttatttataatagccccaaactaggaaaaacccaaatgtctatcaatgggagaattcatagaaaaaatgtgatagagccatacagtgaaatactgctactcagcactaaaaaggaatgaactagtgatacatgcaacaacatgaatgaatctcactgacagtatgttgagtgaaaattcatattcattcatacatatgaaaaattgtaatggatgattgtaatctagaacaggaaaaattagctattgtgatagaaatcagaacagtagttgtctcagggtcaggggtactggagaatgactgaagggcacaagagaaaattttagggggtgatggaaatcttgatttgtcttgagtttggtggtagttacaaaagcgtgtatatttatcaaatctcttcaacccgtatgcttaaaatttgtgcattttattgcatctaaattatatatcaaatttttataaagtacaaaaatttcaaaagggaaaaaatccttcagaagatccccctgctgcaggatctaagtctaaattcctcaacatgatctggctcttacttaatactccttggcttatttctcaccattccctctcacctcctaccacttattctaagctacttatagttccaaaagttgttattctttctttttcctctgaacctttaagcacagcactcctttttcctggaattccttttccattttccatttatcactaaatcattgacatcctttaggactcacagaagtagcacacctcctccaagacgacttgttcactttcaggttgtgttagatgcttcccctcttgctcccagagaacttgaagctcctctccatcaaagcatgtattgctctataatgtaattgtaataattaaaaaaccctcaaacccatagtggactgaggtcatttaatgtacaggcaaatagtcctccacatattcagtaagccctgaattaaatcacatattataaactaatttcttttttattgcattatactaggccctatcatatactttaatattcataaacactgaagtaaatattgctattacggggtttttttagtttttaagttcacaggtacatgtgcagaatgtacaagtttgttacatacataactgtgtatcctgggcgtttgttatacaaattatttcatcacccaggtattaagcctagtatccatttgttatttttcctgatcctctccatcctcccaccttccaccctccaataggctccagtgtgtgttgtccccaccatgtgtccatgtgttcccatcatttagctcccacttacaagtgaaaacataccatatttggttttctgttcctgcattagtttgctaaggataatggcctccagctccatctatgtcactgcaaaggacatgatctcgttcttttttaatggctgcatagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaaacatttattaagtgcatgctacatgctaagtactgttctaactctgcaactgttttatctgcaaagtactattattatccctacttactgatgaggaaactaaagtttaagtaacttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaattcaaggttttctttctttctttctttctttctttctttctttctttctctttctctttctctttctctttctttcttctttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctcaaaaaaaaaaaaacaaaaaaaaaaaaccactaccttttcaagtgtgcttcatcatcttatatactgtccaccacagacccaaggtcatagactatttctgcagcctaacctaccaatcagtcctttaacatagaactaactatacaaggatcctccctcctccaactccagataccttcagtcctttctcagtatgtctgagagccatgatagcatttgtatctctcaaaatcaccctctataagggcctcatctctcccggagatgtcccacacctattaaggtcaacaggaggatttggttctattcttggaattgacagtgttgtaccctgctagcacttacatgatgtgttaattccaatgataattttatcaatgttggtatccactaccatgcccaaatctgaactagaccttctagaactagtttataagtttcttgtgggcagagatttcatttctctttgtataagcctagaatctagcctactatctggaacattgttggtgattgttatgtaagtcgatgatgttgactgccccttcagctaggcagtgatgtatcaatggaaaccatccctgttctgggtgtaatagctttgagttaactagcaatgcattctgtggggcataacaaaatgttgagctagctcctgggcagggtctttgaattgctctgatatttcagcatcactctgtcaattgacataatgctacccctttgggcacaggggtttgtagaatacatagctctgggctgctgcaaaggcatctggattcaaagacagcatgtgtctggctacatctgccaataatatgtgtctggagggttacaaagcaatatgactttatacagatgaaaatgaaaattttaaactgacatttgttgatgtgagtaagggccactgatggaagcagttttagagggcggaagctattaaagagatggagccaggactttgtcagtaggggcaataagaagtataactggctgaaatctgagaaagagctcagaacaaggaccccataataataccaaaaaaaaaaaaaaaaagagccagagcagtaagatagggttttctagtcagtggaggtggcagcagcattgagcctttgaatggagaactggaccagtggggccattctctagagaagtcattttgcatacaattgatgaccaattcaagcctaagaaatgcagtccatgtagtaaaagttacccattattcacctactacttgtagccagtttcccagaagtcttctggctatgtggaagcagggagctaagaagcatggaccctttcctctcctaatcatctcaccctctgatacatgtaagtctctccaccttcagcttttcccctgaggctactcccacaaccatcaaacttttcataatccctggttgcaaaggaagagaggagacaggtggtaagagcaatatcaccttctatagtgggcgtggtcttccctccctctctgagtggtaagtctaatggcttctaaggtttacctcttcatctaacctccgaagttttctcttaaagaaaataatttcctcctttccctaaaactactttatccaaattcagctaccaacgtctctgataccgatcttccttagaatgtttattctgtcctaatacaaaacagttttctctctggtcaaggtcaaagcctctcattaatttttagcacttcttatatacttccctcctgatctgatactctagtcagtcactagactctagtctcttggtgccaatgccaagtttctcatgcagtccaggcatttttctttaatcagtatagcttggaggaatccaagagtcccttagagttaggagtatagaatgcctgggggtccttgaattttattagatttccaacttttcacctggtggtctgtagaaccatttctttagatgtggcagatgctccaatgagttaaagagtggtaagtcaatccaaatctccttttcctttgaaccattcttgttactctgatgagcgtatactatatttattcaatacactcatcaaatatttactaagtaaatacagcagtttatatagtacttgaataaacattcaataaggattttttttaatattcccactgcctagaaacagacttggcacctagtagaccctcaataaatatgtcctgttgccctcaaagtgatttacttccagcataaagaggcagacaataaataaagttggttaaatttgataagtggtatgaagaaaaatatagctgagcaacagggagagagagtgatggggtatgctgtaagatgatcaaggaaggtactctgataagggaacatttgggaagagacctgaatgaaatgaagtaagagctatgcaaatgtctggggaaaaaagaagcagaaaattcaaaggctctgaagcagaagaatgtttggtatgttccagaaagatcagtgtggctgggagcagagtaagaagaggaagagggaaggagatgagttaagaaagcaaaatccaatctagagccttgttggccaaggtaaggactctggcttttattctgcatgaaatggaggaccactggaggattttgagcagaggaatgacaggatctgatgtatgttttaacagcattcctctggctgctgtattgaaaataggtgcaggaagaaaggatacaagcaggaagaatctttaggagagtattacaataatccaggcaagagatgatggtggcttagaccaggatggaagcagtgtgggtggggagaagtggtcagattttagagagattttgaaggaatggctgaaggatttttcagattgattagataagggatatgacagacagagaagaggcatcagtgaccccagggttttggacttcaggaactaaacaggtagaattgccatttctgagatgaggaagcaaaggagagaagcagtgtagaggaatatggggaaagagtttagttaggcttgttaaatttgaggtagctattaaacagccaagtggatatataagtctacactaaacatcactgtgtatcatgaaaataagatgactctcttttgtacaaaggacttgtcattgaagaagtgagtcagtctggaaactgctctgaacagaataagaggtaggatgggataggtaaatcatagtggggtgagttatggccaaaaaaaaaatcttatcaggtgttgattataaattcacaaattacttgatatgttataataaaaatttaactatctaagctcaggtttgcctcacaagtgtcaaagaacaagtcatttaccttgaagagttaagaacatggcagaagttcgtgaccagcctgggcaacatggtgaaaccccgtctctaccaaaaatacaaaaaaaaaaaaaatagcggggcactgtggcacacacctgtagtcccagctactcaggaggctgaggtaggagaattgcttgagcccaagaggcagaggttgcagtgagccaagatcgtgccactgcacttcagcctaggcaacagagtgaaactccatccaaaaaaagaaaaaaaaagaaagaaagaaagaaagaaaaagaaagtctagaccctacttcatttgtttggtcattcatcatttaacaaatgttttttacaggtgcccgccacaacacccagctaatttttgtatttttagtagagactgggtttcactatgttggccaggctggtctcgaactgctgacgttgagtgatccgcccacctcagcctcccaaagtgctgggattacaggggtaagccactgcatccagcctagactttctttctaggaactatagatattaagcttaatgatctccacaaatccctgtgagagaaaaaaatttttataaacagttcattaactcttggaaacggaagggatgtagtgatccttaggagctgcataggttcaccaagaacaaatcaggctgcagaagcctattttcctgttttcatcagactattaaactagttgattagaggcatagcatacacatagtctatcttgccttttaaaaagaaagtcagtggcaatatccagggtatatacaatctttctgactcaccattcaagaatgactaggttcatctcagtttctccattcaaattactttataaatgaaagcattggctagctaagcaggagtctcaaacacatggttagtttcaactcttagaaaagaagtgaatttcgttttctttactacatttcttccttgaattcactgacttgagttggccagaagtatttcagatcgtttaagtttattcgtactaattatgtgaggcctttggttgttgttcttcttcaaagaaagtatgataccttcactgtgggtgttgagtcacaacagttctagaaatctgtgccaggatttcttgctgtgtcttatctttgtgatgtgtttctgaagtaataatagctccaggtggcttgtttggtcatctcttgcacagcactccagaaatccacagaactttattttctagttagaatgaaatgtagaatgtatttgggaggtcatgaggccttagaatcaggtaaaatgaatccagaattcccaaggaggtagtttccatatttcacaaatattattgtaaaaacatctgttctcttccgataggagcattttcaggagttaataaaaatcttaatatctctccacacctgcctgccttccatgtttccgtcctggtaagagaataaaattgcagcatggtgtaatagaagaggtactagactgagctgcaatttcttgattccaatcttgatgtcactgccaccttaccagccatgtgaacttggagaagtcacgtacttctaagcttcagttttcttgtccttaaaacagggataattagccctgcttacctcatagagttgttgtgtttatcaaaagtgttaatgtctgcaaaagtacctcattttattttattttatttttgagagggaatctcgctctgtcacgcaggctggagtgcagtggtgcaatctcagctcactgcaatctccgcctcctgggttcaagtaattctcctgcctcagcctcccaagtagctgggattacaggcacccgccaccacacctggctaacttttatattttagtagaggcagggtttcaccttgttggccaggctgatctcaaactcctgacctcaaatgatcctcacgcctcggcctcccaaagtgctgggatcacaggcacgagccactgcacctggcctacaaaaatacttcaaaaattattaagtgctattactatgctctctctggaaaatgaacacactagtatggtgtgccaggcatttggggcattcacattccctaatttatggacaacaattataatttcttcagaaatgctctctatcagccaaattgcccatttttgttctcactcatgctatccaagcccataggaagaagactccaagcctcacactatggcctacctcatcacagcaaatgatcacatctgcacattgctctgtggcactatctcactctggctggctggctgtatatatgtatccctttttgttagtatttcagaaatttctcttccttgtagtttacttttggacatatcaaaaaacttagtattcttttctactattataaaagagtagagggaaaaacaagattgaaatatatcctttgtacttcaatttttaaaaataataatggaatggggcatagctactattaaattgatacagatgaacatgagagtctatgatgtcaaagaaaacagactttctgcccgtacaaatgttagctagaattaagaattgccctcattttagtactgctcttgtatttattgctttcagtgagccatcactgtggattatcaaatgagagagtaaaatcattttgagagcgatagagtttcaggggcttgttcacaagacaaaagtaaagcttttgaaggctcaccatgtgtgtggactcgaagaggattgttgatttcacatgtagaatccccaaggttgcctgctggtagtgggtgccaacagcttaagtgcccacagcagaacactctggagagtggctttgtatcaaataagacattaagtaagctaaaatatctagcttgctcatactccaaaatatcctttaaaactgtattttcattgatggaactagccctgcagtaaatgatctcaacaggccatcaccactaacacttggttaacaagcatttttagaataccaactgcttgtaagacgttgtaccaggttctgtaattggtatagctaccaaactcctgtacttagtatgtaaggcctaaattgaattgggtatagaggttaaagattaagatgcttaaaatatttatgggattttttaaattacaaaaatgatacatatattataacaaatatgagcaatacagaatcaggaaaggtataatgtgaacatgccctccccacccactgccccgctacaatactgcttataaagttaagacatctttgaggaatatctcacttgcctaaaggaagtcataggcccacctgacctgatgttctctaaaggtccttcctgtctactcagtctctctaaagttccttctagttatttttttctcaatattagggaaattggtgaactctaagccaggagatctagattctaattccagctctgccattagtagttatagtagcaggatgaccttaggaaagtcttacttcacttctctgatcttagtctcttctaaagggttaaactagaatcagtgattctcaactggattgtaagagatccaaaagcatataaggagtttttttttgaagcatgcatactcctgggaattctgaccactctacaccccattaagaaaactatactgaggaaggtactattactgatgagagcatatcatatccttcagatgtattaggataagaaaagatgttgaactactagaatagatggttgaattgtttccttccaactctgatataacttgttactaactattcctgacttctataatataatgataatagctaggctagttttagccaatcagatgatgtctatgtctagatgattaaatactaagggtttcaatttggatggtcagtgagccttttcattagcatccctgagaacgctcaataaggattaagtgcatgcaaatggtttcatgaagtgaaggctaagaaggttaatctgttggctgagtggtgaactgctagctcacttctgtatggctcctcaaaatatcacaggcagatatagatgtgcggtcagaaggcacctgttggctctgtagtgtattacttacacaaccctgccttaccctagattctactccttgacctgtagggcctcttcagtctcaaagataaggaactactacagcttccttttttaaaaaactcattcattcagtaaatgtttattaagtaccaaactagttgttaaatcaatgtttattgatcacccttccagacactaagggcacagtagtgaacaagataagaccctaccctaatcaaactcactgtggatgatttcaatacagtgtagtgaccatataatggggtaagcacagggtgctatgggacacactggcacctgatctagacttgggaggacagggaatgtctcctaataagtgtaacatctgagctgcaaactgatggatgctatagttagccaaatgaagatttgagggaagtgtgcaccaggcagagagaatatacatgttggaaggcttagagtaaagagggagcatggctcatttaaggaactaaaagaagtttgtaagggtgtaggataaagatctaaagtgaaaatgatcataaatgagctggccaagaggggtcaaatcacgcagggctttggaatccattttatggaatttagaaactatcctaaaggcaatggggaagtacaggatcaatgtcaagaatagattatatggcaaatatcttcaaatgctaaacacacatactgtaatccagcaattccacttctatttatagatatactaacatactggaaatcatttatcaatgaagatattctttgctgtactatttataatagcagagaattagaaatacatgtccattatttaggaactcattaaatatgataaatctgtaactggtcatcatggttgctctgaggaagaaaactgagtgtttggggctgaggtgaggagggagttgactagttgaacatgtgcatgttctaccagtttaaaataaacagataaaatttaattttaaaaatagtctggacacggtggcttacgcctgtaatcccagcactttgggaggccaaggtgagaagatggcttgaggccaggagtttgaaaccagtctggacaacatagtgagactgcatctctacaaaaattttttttattagcgaattgtggtggcatgcacctgtagtcccagctgcatgggaggctaaggtgggaggattgcttgagcctaggagttcaaggctgcagtgagctatgattgagcctctgctctccagcctgggtgacagtacaagaccgtttctcaaaaaaataaaaataaataaaatggtcatgatatgccattttctactcattacctaaatacattagcaacaattttataatacattaacatcctattataattaggggtggaaaaactcatatattgctggaaagaatgtaaattgttataaccattttggattttaatctctctggtaaagttaaacattaggatacctgtgatccagcattcactgtcttgggaatctagcctacaaaaataagaattcagccgggtgcagtggctcacgcctgtaatcccaacactttgggaggccgaggcaggtggatcacctgaggtcaggagttcgagaccagcctggctaacatggtgaaaccccgtctctactaaaaatacaaaaattagccaggtgtggtggcatggcctgtaaccccagctactagggaggctgaggcaggagaattgcttgtacccgggaggtggaggttgcagtgagccaagatcgcaccactgcagcctgggcgaaagagtgagactccatctcaaaaaaaaaaaaaaaaatgagaattctagtatataggtcatacataaaaggatatttattatatcactgttttgttgccaaaaggagggataactctaatatctatgaataagaaaatggtaaaataaactacgacatagacatactattgaatattatgtatattattattcagtgtaataataatggtaatattattactattaaaaggaatgagttctatgtagttctgtgtaatggtctgaagtagccatgttctattgctaggtttaaaaatgcaagttttagagtaatgtgtataatatgatcccattttcatagagaaagattttaacatatattttttattttatatgtaaacatatataaaatattttataaatattataggtgtgtgtgtgtatatatatatatataaacataggaacagatgtgggaaagggaagcatcagtgaatatcgattaccttgggtggaagagggttggatgggaagggaataactattaaatggttctttatgtagttctatatgtttgatttgttacaataacatgtgtaactgtaatttataagaatataaaaagtggttaaagtggatagaaaataatggacgtgagagggcataatgaagacaaagaagggaggagattgctgtaatgatacacaaaaggaatgacagtggctgaattaaagtaacagcaataaagacagaagtagatagatttgagttcctaggtagaaaaaataggacttggtgatttgattgaagggagaaaaagaagagtcaaggaagccacccaggtttctggcaaggtactatactagtcactgatataatgatcggggaagaagatgtgtggttttggacaggttgagtttcaggtaccagtgggaaattcaaggaggagaaacctgtaagcagtccaagatatgcatctgaagctcaagagagatagctggtctgaaaatatagatatggagataattagctacattaggactctctcagttacaagtgacagatagctggcctaaattggcttaagattttagaaaagaaggagggggaggatttattgcctcatttaactgcaaagtccttcatgaagctggcttaaaacatggcttaaccttagggcttaaatgatatcatcaggactttctccgctctgctttcctttgtattggcctcattcttcatgtaggttctcactatgaggtgacaaaaatagctactagaagctctagacttacatcttaccaattcaacaagcccagtggaaagaggatgccttattcagtaagaaagatgttggcaacgctggtgagagcagttttagtacagtagttggggcagaagggttcatgatgaaaccagatgaggaattagaaaacagcaaatataaacaaaagagaggaggagaagagaggaatagctagagattcattaagcatctattatgtggaagacactgtgttatattacacccggggacacaaagatgcataaaatatggggttttttttaagctctggaagcccacagccttcagaaaagagaaaatcttataagtaattcacaaaggtgatagataagtacttacatagaagtatgataagactgtcatgggagcatagaggagggaaccacagaatggtcaaccaaatacattaaatacatctctgaggagaagtgcataatggctggcacatactaggcatgcatatatgacgaattaggtgacaattatgttttggaaggtgaatgggactttgatgaagaaagctagacaacccatttctaacaaagggaacagcaagtacaaagctaaccaatcccctaggtttgctggctttcctctcggcatgaggcttagaataagggctgagagaaagccaaaactgttgggcagagaaaatgtgacaagaggccaaaatagcctaagggggccttcaaatgcccattcaggtacttaataagtggcctttcaatcccaaattatcttagcatcttccctacctcactatttctctccgctagcctccatacacagaaataaatgttagcaaggcaagcacaattcttccttgctaataaatataaaatgtaagccatgtataatggttcttaacactggtagcagttttaatttctctgatcttctactataccaatatctggtgcaaggcagcaaaatacatttagtaccttgatgtaatttagaagcaatgattgatcctaccttccttgtgtaagactcttagctgacttagagaacataagtcctatgtaattaacatgttcacaaatgtagagagagctgtttttgaaatggtgaagtaccaaggacgctttgctgtaagcttatgaatcttggctgcattttaccactgcttccagcatgtagctcctttaatgaacctagtactctggtgcattaagtcacttgtttagggtctagtcacgctgaattctatatactgcgagccagaggtctaatcaacctatgctctttgtcacatggtatactggaaagaagaggtctttgtgcagatctattctccctatagcacaacaagtcgtgggcctggcctgctgccagaaagttagtagtgtcatctgtgtagatgaaattcagcaactcattatcttacattgtgccagaagagtgggaagaagattgacttggtaatttgctatgtttcgatcctaatctgtttagaaatatgatttctttaaaaggaaatggaaaagaatgtgtttctcatgatagcttcacagtatctcctgagaggatgttcagttattgtaaatacagcaatttaattctctccttgaatttcagatgtatttcatctctttaaaaaataaatgtgttgaaatgatcagattataaagtatgaattgtatacttccaaaagtggaattttatatttcagattacacaaaaaaacttttttcatgagtcataaagttattggtttgtatactatgttatttttatacatcatctccaaaactctttaaaaataagtttacattgtaacctatttaaaggagaaaggcatatttgcggtacacatattttatctcagagtcatttcagcattttgagtctaattcattcttcccaccctgtagcatagtatgcaaaatccagaagctatcagaagcaaggcccaaatttagtgtagtaaagcttctagtacatgggtgaaatacacacataagaaagaaaaaagaacaaggccaggtgtggtggctcacacctgtattcccagtactttgggagaccaaggcaggaggatctcttgaggccaggaacttgagaccagccggggaacatagcaagacccccatctcaaaaaaaattttttttaattggccaagctgggtggtacacatgtgtagtcccagctacttgagaggttgaggcaggaggatcacttgagcccaggagtttgaggctgcagtgagctatgactgcaccactgcacttgaacttgggcaacaaagtgatgacctgtctcaaaaagaaaaagaaagaaagaaaaaattcagttgatatcaagtttctgacccttagtttctctctgagacagtttggagtaaggaaagagcataagatttaaaatcacacaaatcctagctctactacttttagctttgtggccttggccaagtcatgtaacctctctcaagctaacttttctcattatataatgatagtaatgatacttcctttgataagactttataaggactagagataaattaaaatgcctaaaccattgcaggcaacataacaggtgctcaataattggtaattattagtatcaactgtaaaatgagaatagtactaatttatttctcaggttatgagtcgaatgaatgagaatgctttttttttcaagcaccttaatctcttagctatttcgtagttgaaaagaagttatcctgcttatctcacaggattgtgatgatcaaaaaggataataaatgctaaaacacctagaaaaacataaagtgctgctcaacattgggaccaagcttccctgtatactgaacatctcactatatggtccagaacgggatcttcatggtgattcttagtcctcaatagacagctgtatctagcgtgataagacagggaagtctcaaaacactttacaaagatttctgtcaggtttcaaagtttgctgtcaacgaagtagaccttaattacccagaaaactcatttctgtggaactccttatatggagccaaggaagcaaggtgttaaactgtgcataactcttattaggtgaggactatatagcattgtaattagaaagaaatctgaggtatagtgttcaagccaactctataaatgccgtcttaaagattatataatgtattctaaaatatttcatatggatttctaaagaattgaataacaatcaaatatgctaaacataaaaatgactcaggacacagtttaataattcctgatgccaaatatatatcagaatctgtaggaccttaacaatattatttatgaatataaattattgatcaaaactgtacaagtaaatgttgaagactggaccaaacctgatctgggttgaagtcctgagctccctcactcactcgtcctctaatttggaactagtcagcctccatgtcatttcactgattgctgtagaaggtcaaatgaattgatgtctgtgcaaatgctatgcaaactgtaaaatgatgtacaaatgtgaagtattatttatcataaaagttgaatacagaaaaatggtttgaaacagtttattaatttgggaatgtcaaagaaataagagattatgagaaaaccaaagtcctggttatgtttagtatatcatgcaacattgccatggggtggcaaccatagcaacaaagtaagtaatcttttccaccagacatttctggttacagcctcttgtttgactcaagccagtccccctccttgactgcctttttacctcctcacttttgatccttattcatccttccaagatccagctgtaggcttcatagcctttaagaggccttgataaacctctatccagatagctcatcttagtttacattcttccacgtgcatgcttaagatacttataatttctaggcctttttcatgtgcttctcgcgtcttcacagctatgtaacaagccaaaagaggttagagattccttctatctcggtgtggcaactagcataatgcaaacagttaagtacttaatgaatatttgtagattgaaagaaaacatgctgcaggcccaatgctaaagcatacccttctttcaaaaaagaaaactatatttgaaagagcttaagagatggtcagtagacaatgcagttgtctatgaagccacagtgagttatatatataaaatggcaactaattggtaacttattgggagatcaagggaagaagttgttgtaaatatttgttcatgagggagaagccttcaggctctttccagttctatccctgtaccacagtaatgatactgtgcacaaatggcttcctcaaagggctatactgtgtaatatacataatgttccattttcacatttaaatgtaagttaagaaacaaaattacattgtaatttatcatcacatatttattatctccccttcttctcccaaattttatgatttttctgattgctaaggtatagtgtggcactcttcaccatttattggcataatacagagcttagataacattcacatgcagaacaccctccctggagcccttggggttctgtagatttttctagcacgatggctgtaactaggcccccttttcttcttgctcaagaaagcctatcagaatgtgaataagagtgacactatcatagaaataacatttgttccagtttttatttaagtaaattattaatgaccttcaggacttcgttagtaacaaaatgtttgcagtacacttcaataccacagttgcagtcactggggcagtaaaatggactttggtttcacatttaaggacctgggttcaagttgtaagtctgccacttattttctatgaaactttgaacatgcttcttgatctctcagcctcagttcctataaaatggcaataacagtaatacatcactgggatgatatggggattaaatacaatgttatttgaaaaaccaatttttaaaatgtaaagccctgggcaaatctgagttctgtatccccttatgcacccatgtaattctcctttctgtcattgccatgcccttggtttaggccttccaactacctattgctttgtctccttccttaccttatatgaattcctcatccccttttccttcaaaatcattctcttgtagttgatccaactaacagtcacagattcattttcttttccatttgaattagctataactaactaagctaatctaagctaatctaagctaatctaagccctaactcctagaggttgttcttaattatgaacttgcatgcagtctgggacagaaaaacagaaaactccttacttattttagagttttcaatcttttcctccacccccagataatgtttttatatacaccaaaagtcaagctcttctcttgccttcccaatacctccagtgtatacccacacatagcccagtgctgaaagacagcttagggaatgcagaggaaagggactgaccaccaaaaacaagacaaggatcttgtgggaagacaggacccaagttctctagatggctgaactacaacctcaaatgtcttagcattctcaaaatttgtatgggaaccttcagcagtagggcctggctatacctactgctactgttccaagctctaacaccacgtggtccagtccagtagagcaaacaaagattgtaaaactaggaccagctgccacttacagtgtttcttgggccttcacaagcagctccactccttgcccattgctcctcctactggttctgatccatattggaactccctctaacttgcattgccttctccctcattccctagttgtcccagttggatgagaattgtgagttcctagatctctctcaaaagacattcttccatatatacgacaggagacttatacagcgtcaaaatctaacaacccaaatgcccatcaacagaatagtgtatggataaactacgatatattcatacaatgaaatattaaacagcaaccaaaccaatgaactgtagcaacagttatgaatatgagtgaatcttaccaatataatgttaagcttataaaaagtaaatcccctatgttgaatttgccaacaaaagaaaaaactatgtttgtattaaacgtatttaagaagcaagtcatctcggacctgtaataaagacaaacctaatttaatattgaaaagactaagtcctaaaatattaaatgtagcataataacctttgtaagttacaaacaactaactttaaatatatatatatatattaggaatatatacaaatgtgatataattatatgaaaaggaaattgagggaatgaatgaacacaggattcaggataaagattacttgaaaaaaaaagattacttgagtgggtaaattgtagggagatgagagtgagaaggaaatatatggttgaatgtaagtttttaacaaagtcctagcttttgctttgggtgactgttttacaagtgcttattacattattttattaaagctaaataaatacaaaaataagcaatgggggaaaggagtcactattcaataataatgctgggataactgactgtccaaaataatgaaatatgtagaagaatgaaactggacccctacccatcaccatatacaaaaattaactcaagattgattaaagacttaaatataagacctcagactgtaagaatcctaaacaaaaaccgaggaaacaccattctggacatcagctttgggaaagaatgtatgactaagttatcaaaaacaattgtaacaaaaacaaaaattaagtgggacctaattaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcagaaaacaaataaccccctttaaaaatgggcaaaagatatgaacagacacttctcaaaagaagatatacaagtggccaagaaacatgaaaaaatgttcggcatcactaatcattagagaaatgcaaatcaaaatcacaatgagaaaccatctcacaccagtcagaatggcttttattaaaaagtcaaaaaataacaaatgctagtgaggttgtggagaaaatggaacacttatgcactgttggtgggaatgtaaactagttcaaccactgtggaaagcagtttggagattgctcaaagaactaaaagtagaactaccatttgacccaacaatcccgttactgggtatatatccaaaagaaaataaaccattctaccaaaaagatgtatgcactcatatgttcatggcagcactcttcacaatagcaaagacatggaatcaacctaggtgcacatcaatggcagattggataaagaaaatgtggttcatatacaccgtggaatataacgcagctataaaaaagaataaaagtatggcctgtacaggtacatggatacagctggaggccattatcctaagcgaattaacacagaaacagaaaaccaaataccaggtgttctcacttgtaagtgggagctaaacatcgggtacatatggacataaagatggcaacaatagacactggggactacatgtggagggagggaaggagggagggagagggcaagggttgaaaaactacattttgggtactatgctcactatctggtgatggaatcaattttgctacaaacctcggcatcacacaacatacccatataacaaacctgcacatgtactccctgaatctaaaataaaagttgaaatttttaaaaaactaaataaataaaagtgggctacacatagaccaatgtgaatgtgctataaatgtaaaatagatttcataatagatttcaaagacttagtaccaaaaaagcaatgtaaaatatctcattaatacacatctatattgattacatgctgaaattaaaatagtttaggtttattgggttacataaaaaaaatctattaaaaattaatttcacctgattctttttacttttttaatatggttaatagaaatttttaaattacctatgtggctcacatttgtgactcacattatgtttctatcagacatagaaacgtgtcatggtggtataagaattctagagcactgctctttatgtgtaaacccagctgttttcaggcttaaagctatttagtttgtctttttaggtttaataattctaatttattttttttcagggcttctgaaaccttaattgaaagttttaataaatacaaaagtaatacatgctccttttaaaacaaaattaaatatcagagaaatttatgatgtaacagaaggaatgtaacaccacaatcttagctcccagatatagacacggttaagaattaagaagactttctaggtatatgtgtttttaaagtattagaatgtgaacatcaaagttatccctattctttctcattttttctgacaccagagaggcaacggaagatcatggctcaatgtttgtgccaagcagagaactaaagtagtggttcccacctctggagttacagtcctctatcgttagctggagtttggaatttttttcctggccaaatctcttcccctcaccccaaaaaagtgccatttggcatatgtttacactaaaagctgaagtgaactaaaattagtgttttgagaatttcctaataccccttgggaaaatatcagagacccaatgggatattgtaagaccagaactaacaatcactatttcagggtattgatttccaacaaagtacctgatcatttctctcagtgggtatgaaccaggcttctgatgggagtgtaatgatttggagaaaacaaggtggatctatttctctataggtttctctctgttcttaggaagaaattcaatggaggtagctgtgacagggggagggggggtggaaaaggggtccaaaggtcagatcttgattatgtgctagatcttgaaacttttcttttcaaattgcctgaggccctataaaaatcattaatatagaaatagctattttttcaagccttggactaagtgccatggaaattacagaagttattttctttgttcacattattgattgacaagttcaaagattttggatacatttcttggaacagacatcaaacagtttgacatttttccttttctattcaatgaaatgaatccttcattcaacatcatatgcttaggaaacacaccaatgaatttttaaatcatattctatattacccctgttcctgcactggttgagacctgtgagagaaaaataatacaaactgctcttttactgctattctgattagaatctctttcctctccttttgcagggaaatggcagacttgaactaggcattccaacgaaggcttttctgaaacactttttaagtcattgttctcagccatcctatctattctaaagtccattatcatttttcttctagcctgaaccccttgacaccacaattctaatgtatttgtctgtttcttttttggtcacatgttcatttgtcttgcttctgccttctcttagattggcagttccttgaggtgagagaccatgtctaggtctaattccaaagtaatataaatctacatggtcagaaaatacttattaacaaaattattacctagaacccatttgccccaaactctacctaggtttattttatgaaattaatgctttcatttaaaaccattaagttcacataacagtaaacttcttcaaagatcacacaaaaagataaattggagctagaaacacaaatgaacagcatggaagagttttggatattaatggcccatgtatatatttttcacatttttagtttgcttttgctatacaaaaatgtgtcctgtttatggagtactgtgtgatcttatttattaaacagaacagtatattagacagatcattcagttggaaatacatctggaattcagatctagttcaaacacgaactagctatgggacttacgtgctcagttttttgggcagaggaaggaaatgacctaacactgatcctgataacctcacaagggtattgacaagatcaatgcatcagaaatatatcagaaagtgttttgtaaactaaataccatataaatatgtgggatgtccttacgtttgcagtttcaacattcaagaagaccattcatttcctgttagcatcccttgtactttgaggatgtggccacaaggtcctttggcctttgtcagtatcatcaaaaatgccagcttttagacacagatgtgatttatttgaaagaattatattagctcacttttatcttttaaaaaattaagacaatattttattaaaataactaaacaggcccagcccagtgaggcacgcctgtaattccagcactttgggagaccaaggtggaaggattgcctgagttcaggagttcgagaccagcctggccaatgtagtgaaactccatctctaaaaaaaaaaaaaaaaaaaaaaaaaaaaaaaaaaattagctgggtgtggtggtacacgtctgtaatcccagctatttgggtggctgaggcacaagaattgcttgaacccgggaggcggaggttgcagtgagctgaagttgcatcactgcactccatcctgggtgacagagccagaatctgtctcaaaaaaaaaaaaaaaaaagaaagaaagaaaaaaagcagctttctcgagatataattcacatatcatacacttcacccatttatacaattcagtggtttttagaatgttctcagacttgtgcaatcatcaccacaatttattctagaacaatttcatcacctcaaaaagaaaccctttagctattatccctcaattcccctattccctctcccagtcataggcaaccagcaatctactttctatctcaataagtttgcctattcgagacatttcatatcaatggattcatacactacgtggtattttgtgtctggcttctttctcttagcataattttttcaaggtttatccaggttgtaacatatatcaatacttcattccttttttatcatggtaaaatatacataacaaaatttaccattttaaccatttttaagtatacaattcagtgtcactgagtatattcataatgttgtgcaaccattgccactgtacatttccagaactttttcctccttccaaaaagaaactctgtgtccatcaaacaataactccccatgaccctgctccctgcagcccctggtcacctctattgtactttctgtatctatgactacctattctagttccctcagataagtggaatcatacaatatttgtccctttgtgtctggcttactttccttagcatataagtcaaggtccatctgcgttatagcatatacagtacttcattcctttttgtggatgaatcatattccatttatgaatatactatattttatccactcatcagttgatgaacacaggttgttcctgctttgggatattatgaataatgctactgtgaacattcatttacaagatttttatggaaatatgtttttatttatcttagctatgtacctagaagtggaattgctgggccaaatgttaactttgtgtcagctttttaaggaaataccagactgttttccaaagtagctacatcattttataatcccaccagtagcagataagggttctaatttgtttgtcttctcatcaacacttgttactatttatctttttgattatatcatagtgggtgtgaagtggtatctcactgtagttttcatttacatttccctgatgaccgatgatgtcaagcatcttttcatgtgattattggccatttgtatattttctttagaggaatgtctatttagatattttgcctagtcttcaagcagattatttgtctttttattattaagttatttatatattctggatcccatctcttataagatatattatttgccaatattttgtctcattctgtggatggccttttcactttattgttggtttcatttgcagcacagagtttttaattttgataaagttcaattcatctattttttttcttttatcacttatatttctcattttttagtgtttctattttctattttttagtgtttctattataacttagaaaagtccaggatctgttttttttactgagaaaacttagaaaaggccagggtatgtttttcactgagattttatatcagtcacaactcaagtggctctgtgatttcactgtgatttcagggctttatagcttctttgaccacaatagtctgcctagctttgccatcttagtttctctcatatttgactctctgaaaaatggtatggtctaatctgggtgacaaggagtcaatatttcttctccctcaccctcctgtaaagaccttccttcccatcttacagttggcagaaatggagtgagactatatcatataggtatgtctgtgccttaacatcgaactaacctgtacatggtctctccaataacagactgcattttgcctacagagatctactatagtaagtattctgtaacacttagctatgatgttggctgttaggccctagcaacctgtgctttttctgaatagcttagttacaaaatactgtagcaaaagaattcgtcggagctgattactataacaatgtgccagaataatacttttacatttaaaaaatctagacctctaagattcctctcagccatgaaattatgttaactttgagcagttaaaattattttataaaaactaacatctgatttacttattctagactaaataagccaagtgctgtaataaagatctcaagctatattctaaaaaattatcattgattacattcctactatgttccaggcactatggtaggcactctaatcctcccatcatctctgcacatgaagtggaagttactctcattttacatatagacacagataacaacctcagatatgttaaataacttgagtagagttacaggtggtgtggaaagataagaacaaaaataaagtcttccttgtcttattttgcccctctgggcaggtgttcattttgtctttttgatgcttccagtatctgtgttgaccttttcttgcctgagccttgggcaggctgggctttctgtagagctacttgactggaagctttttctagccacaagcattccactggggttgtgggggcatctgctcactttactgtctcttggtagaaaagcttaaagtgaatttttaaagtgaaagtttagaatcttagtaaagctataagacatagacccaaccccaaactgctgtctcagtggggttcatctctctttaccgctagatccttttatgtcagtaggataggaccttggacattattgccagtggtatacagtatcactatggtatgactgaaagtttgagtactatttctacactcctgtaccacaaaagcaatctcatactatagaaacaaacctgtactgtagaatagaagagaattgagcaggaaatgtttagtttgcattgcaaacttttttattttttgtttttttctcacttttagcatcttgggcttctattctggggattagagatagtaagtaattataatatcaagatgagatgacaatatcattctttttctgttccaagtgaatgatggctctttggcccataagctgtaacacacataagtaaaggggttaaattgaaggcatgcaagaagcaggaaacaaccactacatggtcacgtgggagaaacattagttgaatacagatataattgttagaagtcagtcacgttctctagaagctttttcagacttactgaataccaactttgtgccctcactttatgtgctttacatcattgaattctcataacaatcctgtgaagttagtattattattctcattttatagacaagaaaactatggctcagaaagattaggtaatttgcccaaagccacacaactagtgagtggcaaatgcagagactgaaccaaagtctttttgactccaaagttctttcaactacactgcctccaaatgacttagcatggtcagatacttgcttttttccttgtagtatccactgttatgatcagcctggtgctagtaatgcagcagcatctgaagcatagtggttggaggagaggggaagggggcgtttaaggaccagaaaatggcatctaagataggacttgtcaagtggagacatgggacctctctcctgaaaccatgaatttaaaattgtattctttacactaagaatcccaacaagtaaaagtcactaatacttacagttgagagtgtgcgtgtggggaaaatgttgctgccgttacttttgagacttagagcagctgctattgcaacctccagggtaccctactcccaccagtcttacttttactttacagtaactgtgaatgtcaaatcttgttttaggcacaaggaacaaagtttccctgccgcttacatctttccccccaagaaacacaaagggctttacaaacccacaaaggagcgttgcatagaaagagaacttggaccataccaagagtgattggtttaacactccacacatttccagtgaaattgggaaaggcatcttgcatgcctttccataaacctactaaatctccatctcttcaagtttccttagactctcttttactatggtttattccctaaattattgctactgtcagaaatcctgttagatatccagaaattcacttttgaggatattgtgtgctctgcagattttttttcttaaaaataaaacagagttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgagtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacgtttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcctcagcaaatgtaaaagaacagaaattataacaaactatctctcagaccacagtgcaatcaaactagaactcaggattaagaatctcactcaaagccgctccactacatggaaactgaacaacctgctcctgaatgactactgggtacataacgaaatgaaggcagacataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaacaaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtggacttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattcatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaagcaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctgcaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaagtaggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccattattctcagtaaactatcgcaagaacaaaaaaccaaacaccgcatattctcactcataggtgggaattgaacaatgagatcacatggacacaggaaggggaatatcacactctggggactgtggtggggtcgggggagggaggagggatagcattgggagatatacctaatgatagatgacatgttagtgggtgcagcgcaccagcatggcacatgtatacatatgtaactaacctgcacaatgtgcacatgtaccctaaaacttaaagtataataaaaaaaaaaaaattaaaaaaaaaaatttttttttttaaaaataaataaataaaaaaaaaataaaacagagtgacttccatttccaccaaggtggagaaaccccattcctcctatgtcctccctcttacaactaaaataccctgggtataacacaacaaacaaaactgagtggtgggaagaaaaatgaagactgtcttggaacttgaagaacaagtggtcagctccctgggtttcctttttgcctctcacatatcccagacagggcactacagaagcctccaattcataactgccactaagcacagacaaaaaaacactctaagaaaagcctgtttcctgtatccaaaaaaaaagaggtaaagggtcactttacagcagaaaactttttgaccatacttttcctactccagtgtaacaataacggaaaaagttttaccctccccaccagcctacagcttcagtgggacctacccagaagttaagattctattccatttcttccccccacaaaagcagacagcttgctcttaatccactactagagcattgttggcaggactgagcagacagctcatcgtctctcccccatctgtcagaagcagatggtgctcctattctcctgccagagtagtgtcaacccagtccagtggcaacctaagccaccacacccaccaagcagcaaggagaattaatggctcagtataaggtagggctaattgccagtagatttaaccccccaccatctcatgtcattgctgcccaatgggggtaagaggttgagcttccacccctacctagtatcaaaaagactgaacaaggaactgcatgtcaagactagtaagctcattatgttaagtgaattaagccaggcacagaaagacaaacttcacgtgtcctcacttatttgtgggagctaaaaatcaagacagttgaactaatggagatagagaatagaaggacagttaccagaggctggaaaggataatgaagggctgagaggagagtggggatggttaatgggtacaaaaaatagttagaagaataagacctagtatttaatcatacaacagagggactatagtcaataataatttaactgtacatttttaaataaccaaaagagtataagtggattgtaacacaaaggataaatgcctgaggggatggatacgccatgttccatgacatgattgtttcacattgcgtgcctgtatcaaagtacctcatgtaccccataaatatatacacctactgtgtacccacaaaaattaaaaataaaaattttaaagactagtaagggccagtcgcggtggctcatgcctgtaatcccagcactttgggaggccgaggcgggtggaccacctgaagtcagggattcgagaccagcctggccaacatggtgaaaccccgtctctactaaaaatacaaaaattagccgggcgtggtggcaggcacctgtaatcccagctgttcaggaggctgaggcaggagaattgcttgaacccgggaggtggcggttgcagtgagccaagattgcgccactgcactccagcctgggcaagagagcgagactccatctcaaaaagaaaaaaaattgtttaatttaaaataaaataaaataaaaataaggactttacttttccctcagcccctggtgctagggaggcccggtggaaagctgaacccccacacccacctgacagtaatgagactgaaagaggcagcgtgaagcaaggctagtcaccactcctattcccactgccctgatgtcagcaaggcccagtgaggaactgaaccaccacctccaatcagcatcagtgaggcttaacaaggtggtgaaaggtaaagctaattggcaatccgcttctccccctcccatcccctgatgccagcagggcctggcagggagctgaccttacacctccattcagaggcaacaaaatccagaagccttgtcagtcattgccccactttcacttggatagtatcagtgaggccaagggggtagccgaactttcactccacccatttgcaacaggaaagtgtgagtcagtgccccactttgttgccagggtcatgtcagcagggcacatcaggaagctgaacatacttggccctcacattatacctcacataggggtttcctgctttaaaaagattaaatagaatccagagtttcataatatataataatatccacaatttcaagattaaagttgaaactcactaatcagaaaagacaatccaatggacaccaacaccaagataaatcagattttatctgacaattataaaacagctgtagtaaaatccataataaaaattatctaacaagcaattacaaatcctcctgaaacacagaaatatatatataatctcagcaaagaaatagaagttataaaaataagcaaatagaaattatagaactgaaaattacaataactgcaattttaaaagttggcaaatgagctcaatagtagagtggagatagcagaaaacagaatccataaacttgaggacagatgaatacaattactttatctgaacaacaggaaaaaaaaagatcagagcctcagggaacccgtgggacaataacaaaagatctagtattcgtatcatcagtgtctaaaaggaggggagagagaaagaggttaggctttcttttttttttttttttttcattttttgtgtgttcatagttattcattgaagcattcttatgatggctactttaaaaatatttgtcatataattctatcatctctgtcatctcactgttggctgttggcttctactgattatcttttcttcattcagttcgacatattcttggttcttagtatgatgggtaacattttattgaaaccttaacatttttctattttgttttaatgttctcaatcttatttaaacccgctttagttaaagctttttgtgacactgtctggtaggcgtagaggggctgccacctcattactgcctggtagaagtggaagtgtaggtcccacacttggtctcctctgacacctgaaggataaagagcttctcgttactgctagattggggtaggacttccagctacctgtaactagctatctactgatagctatctactgattgatagctatctactgatagctatctactgattgatagctatctactgatagctagaccagttccaactgccggagtctagttatctgccaggggggatgaaagtgtcagctctcttcttggccttctctgataccacatcagcagggtaccttgttacagcctcatgaaggtggaattctaggctccccactcggcttttgttggttgtttgtgtgaatggggtggggccacaggttttttttctgtagtgtttgactaaagcggatattatcgaaaagttttctctcatgctgggttgctccttttttggtcctttggctcaagagagcaggattttgctagggcttttttttttttttttctgtctgttcttgttggcatttctaggttgctgacttcttcacttccaagtctgggatttatgaggcagaaagaaaaccaggagaacttattaccctgttgctccctgggtcccaatggtcagtccatttttctctgttcttcagattgagtaaactatattcatctgtctttgagtttgttgtttctatattttgtcatctccactctatattttagcccatttagcaagttggcttattttggtcattttaaattttagttatataatttctatttttatttttttaacttctatttttttgttttgtatttgttcattagtttcaagggaattcataattattgaagcagtttttgatgtctattttaaaacttctgtcaaatagctcaaaaatctgattcatccctgtattatatcagttgattttttgattcacattattactcctggttctcattatgatgcgtgatttttttattgtattctggacatttttaatattatgttaggagatttttgaccctacttacatcttctatttaagcactttttaagtacagtgtgtcagctctggcctacttctgtgggctgtaattccaatgacaattttgttttctaagcccttgcaatgcctctattctggtctgcttcatgctctggctctacttgagctcctgcttgactcctactggtgttacctatgggaacagaaggtgcttccatggaccatccagtttcactactagaaggtcaggaatactagacctgcgggacagagaaggttttctcttaactattctccagccacccagagcttgtgggctttccactccatctctgctagtgcctgcagaggaagaaattacctaattgggctcccttctgctgggtagagggacagcaggtacagattctgtatgagtctttgccactaggtggaggttcagaaatctcctagccggagatcattttctgtcattttttgccactctttggagggccaggaggcaccaaggcctgtgttgccttctgccattgggtaaatgtctgttggcagacgcctggcctggattatcttctgttgctaggtaaagggctaggagccactgcatctggggagagagggttgggaagcacctggccagctggcactgctgctgcaagagaagtgcctgccacccactggtgtggggcagaggatgggttagcctgctccggttccactgttgtattaatagttactttaagaagattgggtcccctgccactgggtaagggtttccctgctaagtccttgttgggctttcctttttccaatcctttggccagagacagcaggcttttatttttttcatttttgtctatgcatgttggtgattccaggttgcaggactcgctagcactgggatatatgagagacagagggaaaacccagggaactcaccgccatgtagtttctcaagttgtgatgtccctagccagtccactttctcttttccacttttcaaagcttttgtgattgtccattgaattgtttccagggtatttagttgtagttaaaaggaagaaggcatcttgtcccagaaccagaaccctgacttacatatattttcaattgtaataagtggcatcctattgtctttatgtttcttcaatgtgcttttttcacagaatatcatgtttttgagatccactcattttggtaaacatacatgtataatttattcattttaaatgctataaaatttgctcttatatgaatatgccacaagttatttattcattctcctgttggtggacaatgaggtttccatttctctctattacaaacaatgctgcagtaaatgttctcatacatgtctccttgtgcacatgtgagggagtttatttgggtctatatccagagtgaaattactaggtcccaggatatatacagcatgaactttgtcaaatattgcctaattgctctccaaaatcataccagtctatactcttgccaaaaatgtgtgagatgtttcattttgccacattttcaccaaaatttgtattaatgtagtcaactttattcagctcttttcctatgagtctgcttttgtgtcttctttatgaaatctttccctacactaaagtcataaaaatattcttcaatatgttttcaaatactttaaaaatgttttttctccaatttaggcctttagtctgtgtctgtgacttatttttgtgtgtggtctgataaaagaatcttattctactttttctaatatggatagccaattgctccaacaccattcattgaagagtcctttctttccccatttataatgccacttcaatcatgtttcacgttcccatagagtctaggttgactctgaagtttaaaaaaacccttaaaaaacccttaataaaacaaaaataaataaataatataaaaaagtaaaataataaataaaataaaataaaaataaccccccaaaatgagggttaagtacaatattgagtttaaaatgagaaactttttattacaggtaccccaaataaaaccttaaccttaaactaactttctactagtaaaggaactttgaggatcaggggtagggattaacactgattaagtacctgttaacattgattaagcacctatgatgtatcagatactgctggtcaatttactgccatggtcattttatttatcctttgcaataactttgagaaagaaattatgttattaccattttagaggtaagaatgctaaaactttgaaaggttaagttgcctaggccacacagcaggttggacagagcttaaattcaggtctgtctgattcaaaagagcttgattttgtcagtctactacactgcttccaaggaaagctcacagccctgaactgaggaagatgtgacttgcccactaggagtagaatatgtgttacaatgcactgttgtgcattgaatgaccaagtattctcagaatgactgctttacttgtttgcactcctgactagtgcaaaacatcagtctaagatgagctcctgcttcctctctcatcctcttctagtttatttatatctctatctcatatttcttcaacttgaggtacaaatttggttgtcagagactttcctgctaagctctaggtagcatgggggaagaaaaagtaaacaaggggtggttaagggagggctaaatcacttattcttgttaacaattttggattggatttcatatattaaaggaaccaaatgtaacgctgatgtgatatcagcccttgcattattttatcatgttatcacaattggatattgacttcttattaaactatcattttttcctcctttgaactcggtgctcattgctccctaagactgttatgaagaagttgtagtaagtggcaaaagcaagagatttggtatcagataacataagtttgagtcctaactctgcttttggctctgggatcctacacaagtgatattttcttccttgagcttcaggtttcttctctgtaaaatggacattaacatgagttaatgtgaggattaaataaaataacaattgcaaatttaccttgtaaaataatgtgcaaagggaggttcttattcatctgccattctctataatcatttctgttcttttcacatctataccaacagctccctgctagatgaccctgatgcagcaaccctaatgccattgttctcaaattcataagaatcacctaggacttgctttgtaaatacagatttcctggctctaccctcagattttattaatagatctgagttgaggcccagaaatctgtacttttaaaattctttccagacaattctttaaacacagccagatagaagacatactttgcctaaaacacttaccaccatatatacaaagaatttcttggccctgagtgggattcaaggttaaagcagcttacagtgagaggttataatccccagccttccctaatgttccaaactcctattccgcctaggtcaaagaggacccagccacatgatatcttaacattcccttccactgctgtgattgcagctgcattgtgagtccctagaagcaaagcctagtaaattaaaccagcaattattgctgtttaaaatggtagtgattttaagagttttctttgaaaagtctgtcaataggagcagaagactatgaataacaccaaaatatttagctgtctattgaaatttctttacagtatcaaataaaatgggaacagatgcaactagaccagaacttggttagtaggtaacagatttattgggcttgctcattttaaaaattaaggttataaacaacacatgtcaaaaatcctataaaactgctgtggaaatcatcttcctggaaagccaaaatccctgctaatattctgaatttgcttttcagaactgaaaatggcattgtatacatctgccccactatttgaaacaatgtttccttgagacagagctcactctgccctgagtgtgcattcagtagctaccccaaagtttcaaatacctgctctcttcccagaatgtaatccatccaatcccttgagagaagacaaattctgtatttacaaatacaggtggagttgctatgagttacagttttctggaagttttcatatatagctcatgatttgaaagtaaaaggaagtcatatgacagtgaagtcaccaggtcttccatctatcctgaaggatagagagagacctgatgagaatctcaattggctgtttttctttttactgtcacatatgcaggtttcctgttgaatctctctggtccactgttccctctaatgaagtcatgttctgtgctcagggcagtaatatcttcagaagcagatgtctcccataaagcatgacttcattccttggaatgggaagagccagcagtagactgttgggctaatgggtggggagggctttatttaaaaatagttttctaaaataatgtgtttaactttttaatacatttctataaaaaggcaaattagtttgttgctgttttttgttgttgttgtttttgtttttgtttttgttaacctcactccgtacttccagaaggggcaaccactagaccagaaggaatggagtcctcgcagagcacaggcacttccatccagttgtttgtacagatgggtgaaaattaggattttccagatgctgaatctaggctctgtatcagaccccactgaatcacagcctagatttcaacaagcctttttataacagccctggagcttagaggaaataaactgaagtgcccaaggaaagttactgacccagatgctccagcaaattaggcaagtgggaatattgctagagaagggaagagtagagaaaaagggtggaccaattagaaggatgcagtttgaagtcaatccaaacttgctaaagagaatgggctttccaggctattcctgttcctttagaaaagtacatgtagggcagttcctgaacactgacttctcaaattattaggaataaccaagatgaatggcatcctgtactctctgacatcctatcatcagggcttacaggcactgcccatgtgttctagtgtgttactcacttctatttctgtctatgcagaaggtgatcactaaacaaggtccaaagagctaatttcctaaacatggagggcaaagaccttttccataaacaagatccataaacaaggaaacatgataaggtagttaccatctgagcttggtaccttcaatttgtaaatttaatcactacatccccataagaggtccatttcagttacagctatgcattaaaaatgaagatatgccaataattctgtaaatattgattgatggcagtaaatactgaaattaaatttcctttcccaactcccacattagtcaccttggccagcaaccggtcctcctccagataactctttaagcttcatctccaccataaagcctgatacagtttggctctgtgtccccacccaaatctcatcttgaattgtactcccataattcccacatgtgagtgggagataactgaatcatgggagcagtttcccccatactgttctcatgatagtgaataagtctcacaagatctaatagtttgataagggcaaacatgtttcgcttgactgtcattctttctcttgtctgctgccatgtgagacgtgcctttcaccttccaccatgattgtgaggcctccccggccacgtggacctgtaagtccattaaacctctttttcttcctagtctcaggtatgtctttatcagcaccatgaaatggactaatacagtaaactggtaccagcagaatggggtgttgctgaaaagatacccaaaaaagtggaagcaactttggaagtaggtaacaggcagaagttggaacagtttggagggctcagaagaagacaggaaaatgtgggaaagtttggaacttcctagagacgtgttgaatggttttgacaaaaatgctgatagtgatataaacaataaggtccaggctgaggtggtctcagatagagatgaggaacttgttgagaactggagcaaaggtgattcttgttatgttttagcaaagagactggcagcattttgtcccaccctagagatttatagaactttgaacttgtgagagatgatttagggtatctggtggaagaaatttctaggcagcaaatcactcaagaggtgacttgggtgctgttaaaagcatttagttttaaaagggaaacagagcataaaagtttggaaaattaacctgacaatgggatagaaaagaaaattccattttctgaggagaaattcaagccagctgcagaaatttgcataagtaatcagaagccaaatgttaatccccaagacaatggggaaaatgtctccagggcatctcagaggtcttcactgcagcccctcccatcacaggcctggaggcctaggagggaaaagtggtttcgtgggccaggcccagggtccctgtgctgtgtgcagcctagggacttggtgccctgcgtcccagccactctagcagtggctaaaaggagccaacatagagcttaggccatagcttcagaggttgcaagccccaagccatggcaacttccacttggttttgagcctgcaagtgtacagaagtcaagaattggggtttaggaacctccgcctagatttcagaagatgtatggaaatgcctggattcccaggcagaagtttgctgcaggggcaggatcctcatggagaacctctgctagggcaatgcagaagggaaaagaggggtcagagtccccatacagagtccttactggggcactgcctagtggagctgtgaaaagagggccaccatcctccagaccccagaatggtagatccactgactgcttgcaccatgcacctggaaaagccacagacactcaacaccagcccatgaaggcagctgagagggaagctgtaccgtgcaaagccacaggggtggagctgcccaagaccatgggaacccacttcttgcatcagctggatatgagacatggagtcaaaggagatcatttcggtactttaagatttgactgccctgctggatttcagacttgcatggggcctgtagcccctttgttccagccaattcctcccatttggaatggctgtatttacccaatgcctgtactgtacacttattgtatctaggaagtaactaacttgcttttggttttacaggctcataggcagaagggacttgccttgtctcagatgagactttggactgttgacttttgagttaatgctgaaatgagttaagactttggaggactgttgggaaggcatgattggttttgaaatgtgaggacatgtgatatgggagggatcaggggcagaatgatatggtttgtctttgtgtcctcacccaaatctcatcttgaattgtactcccataattcccatgttgtgggagggacctggtgggagataattgaatcatgggggcagtttcccccatactgttctcatggtagtgaataagtctcacaagatctgatggtttgataaggggaaacatgtgttgcttggctctcattctttctcttgtctgccaccatgtgagatgtgcctttcaccttccaccatgactgtgaggcctccccagccacgtggaactgtaagtccattaaacctctttttcttcccagtctcgggtatgtctttatcaacagtgtaaaaacagactaatacaaagccttcctagggcaacctcccagactttgtttcttatctccttgagtccatccttcctgtctcctccttctgtacctttgtctttcatccttcccacctctgatgcctctagagacaataacattggtgcctgaaataaaaataaatggaaaacagataagaagagattatgaacttttaaaaaatcattgtagctgagtggactgagaaaaataaactgaggtcgtgtatgagttgttgtctctcaagaaagtgtcacacactaggaataaccatattatttttaatgaaggatactggactttttttctaccagggagaaaaaagtcacccaatgatatcctagaaaaagggagttagggctaagtatagtggctcacgcctgtaatcccagtactttgggaggccaaggtgggtggatcacttgaggtcaggagttcaaaaccagcctggccaatatggtgaaaccccatctctactaaaaatacaaaaaaaattagctgggcacagtggcaggtgcctgtaatcccacctactcgggaggctgaggcaggagaattgcttcaacccaggaggcagaggttgcagtgagctgagatggcgccattgcactccagcctgggctacaagagtgagactctgtctcagagaaaaaaaaaaaaaaaggaaaaaaagaaaaagagaaaatgggagttaggcccaaatcgagatattacagaacaaaacagttcccatgttccttaaactgttacaaagcatagaaagagaaataattcctctcagttcatgttataaaattggtataaccttgataacaaactcttccaaagcagcaccagaaagacaactaaagatatctcacataaaaatcttaggtaactactagcaaatcaaaccatgcaatatatttatagtgtgtcatgaccaagtagggtttgtcctaggaatgcaaagattattcaataataggaaatctcttaatattatattatatcatcaactcaaaggatataaatcatttgatcacctcagatgtcacaaaggcatttaataaaaatctaacactctttcctgattattcttagtaaacgaggaataaaagggcattctctaatatgataaagaatatcttggcctaataaacagcatagtacttaatggtaaatatattagaggcatttctgctagaattgggaataagacaaagatgctcattgtaactgctgatgttcaacattattcttgaagttcttaccaatgtaatggggcaagaaattgaaataagagatatcactgttggggaattatacaaagtaccattatttacagatattgttctatagctagaaaacccaagagaatggattaaaaagatattataaatagcaatcaccgaggtggccaggtcttatattatctgtttgtagtacaaatatggtactagcatatcttgtgttcaaacaacatttataagttgaatataattgaaagaattaactgaaaaagaactttctacaggcagttaaatccttcaaggccatttcagaatcttgctgtgtcttgggataattattgtgaacaccaatttatattggataaagaggttcagttaattgagatttctgtttgcttgagtttgggacaaatgaagtttatatggttatagaattttgcaaaaagatgaatttgtctttattgagtgcctagagaatatcttacacttgcttttcatgttatcttgtataaacctcataacaactctataaggtaagtaatagtatccccattttataaatgagaatgtactcagagagatgaagcaatttgctcagtgtcatgcagcacttactaagtagtggagctgggcttgaatgcagttctgtgacttcaaagaccatgccttttccactagtgactttcaattatgtgttcaatttccctggaagagaaatgtatttcctgggacaaagttctgctgagtataatgtatagaggatggccaacacacagctaccaaaacagacactgcctttatggagaagggggtggcaataatgaaaatattaaaggcaagataaatacttaccatgttgaaggataatcccagaagaatccaggtagtatacccttcttggggaaaaaaattggattggctctttctaaatcaaagtattagcagcacctccatcctagggcaggcactaatgtaaatgactggagtacatacaaactgaacatcagaaatccttagtttgtcccatcagaagaagaatctagtgtgactcaggataagctccattcctgattaaagggacacaacatgcacaatagcacaatagctagccatcttgaactgttctgggacccaatctagagccatgttgcatatgtgtggttctcaatgtaatcgctgtttgtggtttggtttggctggccagctgccatggtagcactcctcctcagtgaagaggagccagccaaatggctgtcatcatatgcttctgggaacagcacattgatgccagccatttgggccccttcagcccattgatggggttaatctgccgacagtaagacagggtagctctgatgatttatgtcacatcccaaaagtagattcccttctgactcctatgttctgctgaacaaaaaggttggatgataaattgccagtgtagcctttactatgtttagtgagttaacacatctcaactactgaagcaatccatttgattcatgtgcatactgcttaaaataattttttgcatttccttagcacttcatactttccaaagctgtttttgcttctattatctcattaatcccaagagctggagatggaatactctggaatattcttaacctcagacttctgttgagcccaagtgaaggagaaatggtgttcagggcttgtcctagagtagtggttctcaaccttggtcacacattagactcccctgggaaggtttgaaaaatcctcatgcccaggtctgaccccacaccaattgcatcagaattcctagggctggggtccaagcattgagagtttttgaaactccacaggtgattacaatgtatagacagatgtgagaaccactaagaagataaattcaatctgaggcatgagagttcccggtaacaggaatgcgttcaagtggcaatgtcacagtggtattagagacacgggctgtatcattctccatgagggttgaagtcctggaacaaaatgtgctcatgaaagagtgtgtagataaagaaaagcaggggcctgaaaactaacttttgatattcatagtgttaaggtttctatctgtgttaacctagtttttttttcaaaggcaacatgatttcataatgaaaaaaaaaaacatgactaatcagaggcctttgtggaaggaactgtgcatatatctaaagggatcaatgggtgtaatttatttagactttcaaaaaatctctaactgacgttctgcagcaaaggttattatgctttaagttatgtcaccatgaaccatggaattagaggggccatcctatgaagagggcttgaatgcagggataaaggggagtgataaatgctgtttctggttttattaaacatttttgtatatagtctaggtgaaagagtttgcagtggaatctctaagtttgcagatgatgaatcatttagtccaaacacccattcaaagttctgccacttactagctgtgtgacccttgaaaagttacttaacctctcttgtcctgtttcctcaactgtaagataatggaattggacatgaacatctcagctagaaattctgtagattagcttaactcagctcccctctttgtgttgataatgaaaacaacacataatcaagttctttggttgattagggcaatgttagagagtgacaattatggggtcaaggaccagagaaagcaattgttatacagaattattcactatacagagttcattgtaaccagattgacaaagcactatttctgccagccatctgctggaacacaaaaatagctttgttatacaggaccgtcctttataattggatttaacctgtatgacagatttcttcaacaataaatttataaatccttgtatagcattttagacctgaggttcataaaattttggagtaagaggtcacctagtccatacctatatttggcaggaggagagagaaatgcagacaggtgaagtgattcgcccaaggtcagacagcaaataagtcatagagctgtatctctggacaactactccggttttcttctccctacactcagttctcaaagcagtcaggaatatagccatttgagtcccaggccagacctattttgaagctgtttggttagccctgccaggtaggtatgtggcttgataatgatggtgatagaaaatgaatgtgatgatgatagctgctatttattgagtgcctatatgtgctaggccttgtgttaagtactgtaaattatctaattcaatcctcctgacatcccttttgaggtagatattattgtcccaattttcataaatgaaaaaactgattgagaggtgaagtaacttgcccaaggttacatagctattgaatattattatagaactagaattcaaacccagttctgaaaagttaacaaagttcatgctgtttccacaaccccagtatttcccaaacagtacaatacagaacattaagtcaacaagagataggtatttctttaaaaagcttctataaccaaataagtttgggaaatgctgcatttcatatcccctttttgaagagtcacatttctaagtagtatattaaaggatatgagaaatcttcaatgaagaaatctgtttttccttaaccatgtgtttcccagactcttttttgaccaaggagccccatttccaataacatccgttgatgtcacacaggaccctggtgctctctagaacacagtgtgaaaaacactgcatgatctcccattcatctttctgattatcttcagagattgttacccttaggcctggctttctccatcctaaccactaaagtgaccaaagactaagtgttgcagaatacttatttagcaaagaaacacgcttatgactttgggaacatatttggtacctatacctcatgaaactttgagggaccattatgcttctgaaatgtcagtagttggtaggactcttttagtactgtcttaaccacagtaatattttttagtcttttccaaactaagccagaactgagccagagaagtttcacagctgatcataacttaagtttgtggagcctgaagccccagagatgggcccctgctgcaagggctagagaggaaatccttggatgaggaatgtaagccatctcgcctaagaaatacttgagattgggatgggatggggcgggatgaaaatcaacttgcaaacccctaccttttcttgcctttttgtcacgctttacagcagatgctgaaactgtaatctgggttctgaacatgggcattccatgtggttctcattcaaaattctcactcttctttgaagctaatggcttctatcttcttcatatatattgagcttgccacgcatatttgcacatttcctctgtttacaattctaatagtgtgagatagaagataaactcttaagatgccaagatttgaagatacaaactgtattgaagaatggttttctttttcttgaataaaatgtccattcctgtacctccctggttgctagccattgccttctctttattcctttactaactggtactgaataaatgttgacaatgtccagttctctggtattgttctcaacataaagggagaaaagcatgaaagctagaagcctgggccaggagcagtgactcacacctgtaatcccagagaggccaacgaaggaggattgcttgaggccaagatttcgagaccagcctgggcaacatagtgagaccctattgctacaaaaaatagttttaaaaagctagctgggtgtggtggcacatgtctgtagtcctagctacttgggaggctgaggcaggaggattgcgtgagcccaggaggttaaggctgcaatgggccatgattgtgccactgcactccagcctgagccacagagcaagaccatgtatcaggaaaaaaaggtgggggaaagctggagcctactacctgtataaccagagaacaaataaaattaaattaaaatttatgaatacctactctatgcacatgactttcatttatttaggccataaaataactataaattgatagaattatgcccattttacaaatggacagttttttgaaactattatcgttaatactttaagcttagcatgactgtgattcaatggaaggtacaatgagcttggagtcagaatcttggtttacttcccaggtttaccactttcttcgtcattcgtttgttcattcaacaaacatttttattgaacagctactataaaagaaatgctttaggagctggagatacagagatgagtaattcacagcccttgccctcaaggagttaacaatgtattaagtagaacgatcacatatcagaaaattataatttgataaatgcaacagtgtgttaatggaacacagaggaattagtgtctgacttttaaagttttaaaggatgtgtaggtattgagggaaagtgggactggagaagggcacttcaagcagagggaatggcatgaagaaaggtacagaggcaagaggtatgtgaaaggtgtggtggatgtagagccagggcttggagattcatgttgaactacatgccatgcagtgttgcttttaaactagtggatgttttataaatttatttttataattacagactatttttagaacagtttttgtatacaggaatattgaacagaaacagagagttcctgtatacaaagagttcctcttcccacccttggcaaccactgatctttttactatctctgtagtttttccttttccagactgccatatggttggaattatacagtatgtagcattttcaaactgacttctttcacttagcaatatgcatttaaggttcctctgtgtctttttctggattgatagcttatttatttttattgctgaataatattccattatatggatgtccacagtttatttaaccatttacctatgaaatgacatcttagttgcttccaatttgaggcaatgatgaataaagctgctataaacattggtatgaaggtttttgtgtggacataagttttcagcacatttgggtaaataaacacctaggagcacaatttatgggtcatatggtaagactatgtttagctttgtaagaaactgccaacctgacttccaaagtggctgtaacattttgcattcccaccagcaataagtgagagttctttttgttccatattctctcaagcatttaatgttgtcagtattttgaattttagcccttctaagagatgtttggtgctatctcattgttttaagttgcaattccctgatgacaatggtgttgagcatatttttctatgcttatttgccatctgtatatcttctttgttgaggtgtctatgcaagtcttttgcccatttcttaattggatcatttttttctgatttttgagttttctgttcagatctttgcccatttcttaattgggttaactgttttcttattgttataagagttctttatgtattttggataagtcctttatcagatacatgttttacaaatattttctcccagtctgtggcttgtctcttgattcacttcacagtatctttctcagaaatttttaattttaatgaagttcaacttatcagttttttttctttcacagattgtgcttttggtgttctatctaaaaatttattgccaagcccaaggtcatctagatttctcctatgttatcttataagagttttatggttttgtgctttgcatttggatctatgatccattttgagttaatttttgtcaaagttgtctagatttttttgtataaatgtccagttatcccagcaccatttgttgaaaaaaaaactatcccttctccattaggttgcctttgctcctttgtcaaaaatttattgactgtatttgtgtgggtctatttctgttccattaatttgtggtatttcacaaataccactgtcttgattactgtagctttatagtaagtattgaatcaagtagtgtcattcttcaactttgttgttattcttcaatattgtgttggctgttctgagtcttttgcctttccatataaactttagaatcagtttgttgatacccacaaggcaacttgctgagatcttgatattgtttggctgtgtccccacctaaatctcatcttgaattgtggttcccataatccatacatgttgtggaggggcctggtgggaagtaattgaatcataaaggcagttactcccatgctgttctggtgatgctgagtgagttctagtgagatctgatggttttatgaggggctttttcccctttgctcggcactcctttcgcctgcctccatgtaagacatgcctgttttgccttctgctatgatggtaagtttcctgaggcctccccaaccatgtggaactgtgggtcaattaaacctcttttctttataaattacccagtcttgggtatgtcttcatagcagcatgaaaatggactaatgcagatcttaattgggattgctatagacaaagttgggaaaaagtgacatcttaacaatattgagtcttcctatccacgaacattgatcatggataggaagacacaacattattaagatgtccattgatttagatctttattttctttcattgaagttttgtatttttcctcatatagatattcatattttgttagatttatacctaagtatttctctatatattatgttaatataaatagtgtttgtttttaatttctaaattccagttggtcactgctggtatgtaggaaagcaattgatttttatatattaggtgtgtatcctgcaaccttattataattgctacttagttctagaagatttttgttgattccttgggattttcacatagacaatcatgtaatctgtgaacaaagacagttttgtctcttacttctcaatctttatgcctcttatttcctgttcttgcctattgcatcagctagcatttccagtattatgttcagtaggagtggtgaatgggaacatccttgccttgttcccaatcttaaagggaaagcatctagttcctcaccattaaattagctgtatggtatatggatgtccaatattccaggatcataaatattctgaatgttatagatgttctctatcaaattgtggaagtgccctttgattcataattggctgagagtttttatcatgaagtgatgttgcattttgtcaaaaatccttttttggatctattgacatgatcatatgattcttctttaaccttttgatgagtaatgggattcaattgatttttgaatggttaaccagccttgcataccaggaataaatcccatttggttgtggtatataattattttaatacattgttggctttgattagctaatattttattgaggatttttgcatctatattcaagagatagcagtggtagttttcctttcttgtagtgcctctgtctgtttggtatatcagggtaatgctgacctcatagaatgaggtaggaagtgttccccctgcttctatttccttttttatataatttcaacttttattttagatttgggggtacatgtgcaggtttgctatatgggtatattgcacagtgctgatgtttggagtatagatgatctcatcacccaggtagtgcctctgattttagtttttgaaacagactgtagggaattagtatgatttcatctttcaatatttgattaaattcaccagtgaaaccactggggcctggtgctttcccttttggaaggttacaaattgtcaattcaatttttttattacatataggcctacacagattacctgtttctccttgtgtgagttatggtagattgtgtcttttaaggaattagcccattttacctaagtgatcaaatttgtgggcatagagttattcataatattcttttattgttcttttaatgtccatgggatcaatagtgatggcagcccctctgtcatttctgatattagtaaaatttgtgtcttctcactctttcttggtaggagtttgtcaatttttttgatctgggaaccagctttcaatttcattgattttctctattgctttcctgtttttactttcatttatttttgctctcatttttattacttcctttcttctgcttactttacatttaatttgttctttacttctagtttcttaaggtagaagcttagatattgattttatatctttctcctattctaatatatgtatccaatactataaatttccctctcagcactgcttttgctccatcccacaaattttgataggtttcattttaattgtcatcttgttcaaaatatatttttaattttccttgagacttttcctttgacccatgtcttatttagaagggtggatttgtttgtttgtttgggttttgttttgttttgttttgttttgttttgttttgttttgatgcggagtctcgctctgtctcccaggctggaatgtagtggctcagtcttggctcactgcaacgtccgcctcccaggttcaagtgattctcctgccttagcctccagagtagctgggattacaggcatgcaccaccatgcccagctaatttttgtatttttagtagagacagggtttcaccaggttggccaggctggtctcaaactcctgacctcaggtgatctgcccgtctcagcttcccgaagtgctacgattacagatatgagccactgcacccaacctagaagggtgtttttaaatcaccaagtagtttgggatttttccaactatcttgttattaatttttagtgtaattccattgtgatataagagcatactttgtatgatatctctttttaatttttaaggtgtgttttatggcacagaatatggtctgccttgttcagtgttccatgtgaatctgagaagaatgtgtatcctactattgttagatgaagtattctataaacgtcagttagatctagttgattgatggtactattcagctcaactatattgtcactgattttctgcctgctagatctggcaattactgaggacatattgaagtctccaactaatagtagattcctctatttctccttgcagttattttgccttatgtattttgatgttctgttgtcaggcacgcatacattaaagattgttatgttttcctggagtactgactcttttttatcataatgtaatacccatctttttccctaatcattttccttgctctgaagtcggctttgtctgaaattaatacagctatcccagccttcttttgattaggagttagcatgatatatctttctccatccctatactttaatctacctgtgtctttatatttaaagtggatttttttatagacaacatatagttgggtcttgtttcttcattcactctggcagtctttatcttttaactggtgtgttcagagcattcacatttaaattgattattgatatagctggattaatatctatcattgtattagtctgttttcacactgctgataaagacatacccgagactgggtaatttataaagaaaaaaggtttaatggacctacagttccacatggctaaggaggcctcatgatcatggtggaaggcaaacggcacgtgttacatgatgtcaaacaagagagaatgagagccaagcaaaaaggggtttctccttataaaaccatcagatctcgtgagacttattcactaccacgagaacagtgtggaggaaactgcctccatgactcagttatctctaccgggtccctcccacaacatgtgggaattatgggagctacaattcaagatgagatttggattggggacgcagccaaactatatcaaccatatttgtaattattttctatttgttgccatttttctttgtttcttttttttggcttccactttttctgccttccctgattttaattaagcattttatatgattccattttctcttctctcagcatgtcaattacactttgtttaaagaaaagtttagtggttaccctacagtttgatacatacatttgcaactaatccaagtccattttgaaataacactatactacttctcccaatccttccctttcatcccttaaaatactgctgtgatttgtttcacatatccacatactacaatcacagaaagcatttttgcattttcgctttttttttttttttggagacagggtctcactctgtcacccaagctggagcgtagtggaatgatctcggctcactgcaacctctgcctcccgggttcaagcaattctcgtgcctcagcctcccgagtagctgggactacaggcatgagccaccatgcctggctaatttttgtatttttggtagagacagggtttcaccatgttggccaggctggttattattttgaacaaactgttatctagtaaatctattaagaacaagtaaaatgttttattttaccgtcatttatttgttatctaatgtgctttccttctttatgtagatctaagtttctgacctatgtcatttgccctcaccgaagaacttctgttaacatttcttgcaaggccgatctactagcaacaagctccttcttttttgtttgtctgaggaagtctttatttctccttcattttgaaggatggtttcactggatacaaaattctagcttgctattttgtatgattgatcctcatcggaaccctgggctttgagtagagacagagtatgtagtgtcccctaatttagcagttgaagaaccagaagaaaagtcacttgccctatggtcattttgtggttgagtaagcactagaatctggctagacctgctgctgctggcctccatggccctgattccatcacaagatccccttttcttattgtcagataggcaaactacctgcccatattgatcaaaatttgtccaatcccaattttactcctatcaaagcagtcccccgtactgcatagctatatgtccccctctgatgcaggtgggttttgtcgaaagaaaacatatggttacaaatagggggaattggaatgatataaaaatgtagcttattacactagaaatagatatgtaatagtgatagtgctctgaataggtatgaataaggttctgaagcatatagagaaaacaaatagatgtatctaaaagattatagaactcatcagggattactgcttttgctctgagtcaagatgctcgcgtctagtatgggacagctctagctccctgacattttctctctagaagctgcaactacagtagcctcaagtgaaagcagtgaacatggtagagacagagccaaatcttaaaggtccgtgttgaaaataataagaattacttactggtcatggtgagctatcttagaacaagaagaaactcctatactgctgaaatgatgtacttattagcacttgtgggaaatgtgatactgtctaatgacaatcttgtgaatacttttacatctttgttttttcccaagggatatgccaaatgttcactaagcaggagctctctgagagcccttctatgacccaaactatagtggaagaagactttgtgagccccgagcccagcaaagctgccttacggaaaagcagccagactgttttccacgtggatctgtgtccctgctattcctcactgagcaaggcctcccgacctgagaccccagccaccccaccgctacctgggctcttgggccagtagcagctctgcacctccctgggacagagctcccagtggaagcaggcaggcctgccacttttgctgcttcacagctccctcctctaatgccctcaggctcaggagagagcaaggtgattaaggactatcatggacctccagcacagtgcagatgccttacagaaaagcagccagactgttttccatgcaggtctctgaccttgttactcctcactgggcaacgcctctccacctgggcccccagcacaaccaccctgcccctgcctgaacacttgtcagtggtggctctgcatttctctgggaaaagaaatcccagagacaacctacagcccctctcccattgcagctgcagcggtatcgcccttactgcccatgggctggggaaggaacaaagggcctggttgtgtcactgtacctccagcacactgcagcaaccacagggagaagagcacagtagctcttccctgtgagtccttaccccctacacttcaccagatagggcccccaacttgggatctcagagtagctgccccaaccctgactgagcattcccgctggtagtggctgtgttcccctgaggtggaacttatgaggaaactgacagcccctctgccactgccactgcagtggttctgctcttgctgccttcagactgaggaagaaacaaagagcctaagggctttacttatacttccagcacaccacagttgccatatggaaaggagcccagtctctcttcccagtgagcctctgaccccctgctcttcaccaagcagggccccagctcaggcccatagtgcagctgccccaccctctggctgaacattcccattggcagcagctctgcatttctctggggtggagctcccagagacgactgaaagcccttctgccactgccactgcattgatactgcccttgctgctctctgactggaaaaggaactaagatcctgagtgctttactcacacctccagcataccacagctgccctaaggagaagaggccagtctgtcttcccctacaatacccctgcctccctactcattaccaggcagggtgccctggcttgggcccacggcacagctgccctaccccaggctgattgctccaatcggtagtggctctatatttatctggggtggagctccaagatacaagtggcaggccctctgccattgccactgccaaggtcctggccctttcagtccccaagctggggagggaacataatgcctgagcacagcccaggagtgccaagtggagagctgagagctgagatctacagccagcactcatgtaggaagggagcccacaccctcagatcactgagagggagcacagctgaagacacaaggaaatacagaggaaccacatggctgggcaagagcctgcctactggccattatgcctaagtgctatctactggatcacagctcaaatttcaacaacaaaaatactttgctagcgtaccccccgataaaatcaaggacaagagttcagctacaaatgaagacctagcgcaaagcctcagccctctgatacatccaaaaacaaagtcaactgaccataactgaaattataccacagttaaaggaacatcagcccacgcagatgagaaagaaccagcatgagaactctggcaattcaaaaagccagagttctccttacatccaaatgaatgtaccggtatccagcaagagttcttagccaggctgaaatggctggaatgatagtcataaaattcagaataagattcaggagaaagtcaaaacccaatccaaggaatctaaggactacaataaaatgatacaggagctgaaagatgaaatagacattttaagaaagaaccaaactgatgtgatagaactgcaaaatacactataaaaatctcataatgcaattgcaagtattaccagcagaatagactaagctaaggaagaacctcagatctcacagactggttctccaaactaaatcagtcagacaaaaataaagaaaaaaagaattttaaaagaacgagcaaaacctctgagaaatagggaattatgtaaagacatcaaatctaacactcattggcatctcttgaaagagagggagggaatacgagcaacttggaaaacctacttgaggatattatccatgaaaatttccccaaactcgctagagaggccaacattcaaagccaggaaatgcagaaaacccctatgagatactgtacaagacaaccatccccaagacacatagtcatcagattctccaaggtcaacatgaaagaacaagtattaaaggcatctagagagaaggggcaggctacctacaaaggtaaccccatcaggctaacagtggacctttcagcagaaaccctacaagccaaaagagattgggagcctatattcagcattcttaaagaaaagaaactccggccaggcacagtggctcacgtctgtaatctcagcgctttgggaggccaacgcgggtggatcacctgaggtcaggagtttgagaccaccctggccaacatggcaaaactctgtctctactaaaaatacaaaaattagtcgggcatggtggtgcatgcctgtaatcccagctactcgggaggctgaggcaggagaatcacttgaacccaggaggcggaggttgcagtgagccgagatcacgcctttgcactccagcctgggcaacagagtgagactccatctaaacaacaataaaaaaaagaaactccaaccaagaatttcatgtccagccaaactaagcttcataagcagaggagaaataagatccttttcaggcaagcaaatgctaaggaaattcattaccaccagaccttacaagaggtccttaagggagtggtaaatatggaaatgaaagaccattactggctaccacaaaagcacaattaggtacatagaccattgacactataaagcaactatacaatcaagtctacataataaccagctaacaacacaatgacaagatcaaatttgcacatatcaatattacccttgaatgtaaatgggacaaatgcaccaattaaaagtcacatagtggcaagttggataaagaagcaagacccaacttctttcttcaagagacccatctcacatacagtgacactcataggcccaaagtaaagggatggagaaaatctgccaagcaaatggagaaagaaaaaaaaaaacaaaaaaaaacagggattgctattttaacttcagacaaaacagcctttaaaccaacaacaattttaaaagacaaagaagggcattacataatggtaaatggttcaattcaacaagaagacctagctatcctaaatatatatgtacccaacacaggagtacccacatttataaaacaagctctgagagacctacagagagacttagataaccgtacagtaatagtgggagacttcaacaccccactgacagtattagaaagatcattgaggcagaaaactaatatagatatttcagacctgaacttgatacttgaccaaatgagcctaacagacatctacagaactctctaccaattaaaaaaaaacccagaatatacattcttcttatctgcacatagcatatgctctaaaattgaccacacaattggccataaaacaattctcagcaaattaaaaaagaaaaacagaaatcataccaaccacactgtcaaaccacagcacaataaaaatagaaatcaataccaagaagatcactcaaaaccatacaaataacctgctcctgaatgacttctgggaaaataatgaaattaagcagaaaccaagaaattctttgaaactaatgaaaacaaagatacaacttaccagaatctctcgggcactgctaaagcagtgctaagtactagatgcccacatcaaaaagttagaaagatctcagattaacaacctaacatcacactttgaggaactagaaaaacaagagcaaaccaaccccatactagcggaagacaagaaataaccaaaatcaaagctgaactgaatgtatttgagatgtgaaaaaacatacaaaagatcaatgaaatcatacttggttttttgaaagaataaataagatagaccactagctagagtaataaagaaaaaaagagagaagatcaaaataaacacagtcagaaatgacaaaaggggcattaccatcaatacaacagaaatgcaaaaaaaaaaatcagagactatcaaaaacacctctatgcacacaaactagaaaacctagaagaaactgataaattcctggaaacatacaacctcctgagactgagccaggaagaaattgaatccctgaacagaccaataatgagctccaaaattgactcagtaataaatagcctgctaagaaactaaaaagcacaggaccaggtggattcacagccaaattctaccagatgtacatagaagagttggtaccattcctactgaacctattccaaaaagttgaggaggaggggcttccccctaactcactctgaggccagcatcatcctgctaccaaaacttggcagagacaaaaaaaacttcaggccaatatccttgttgaacataaaagcaaaaatcctcaacacaatactagcaaactgaatctagcagcacctcaaaaaagctaagccaccacaatcaagtaggctttatccctggaatgcaaggtttgttcaatgtacgtaaatcaataaaaattattcaccacctaaacaaaactaaaaacaacaaccacataatcatctcaatagatgcagaaaaggctttcaagaaaatacagcaccacttcatgttaaaaatcctcaacaaactaggcattgaaggaacgtactttaaaataataagagccatttatgacaaacccacagccaacatcatactgaatgggcaaaagctggaagcattcttattgagaaccagaacaagacaaggatgccctctctcaccactcccattcaacacagtattggaactactagccacagcaatcgagcaagagaaagaaataaaaggcatccaaataggaagagaagaagtcaaactatccctctttgcagacaatatgattctatacctagaaaacccccatagtctctgcccaaaagctccttgatctgataaacaactccagcaagtttcaggatataaaatcaatgtacaaaaattagtagcattcctatacaccagcaacatccaagctgagagccaaaacaagaatgcagtcccattcacaacagcccaaaaagaataaaatacctaggaatacagctaaacaaggggtgaaagacctctacactgagaattacaaagcactgctcacagaaatcagagatgacacaaacaaatggaaaaaacattccatgtttatgcgtcagaagaatcaatattgtcaaaatggtcataatacccaaagaaatttacagattcaatgctattgttatcaaactaccaatgacattcttcacaaaactagaaaaaactattttaaaattcatatggaaccaaaaaagagcctgaatagccaaggcaatccaaagcaagtagaacaaagctggaggcatcatattacctgacttcaaactatatgttaaggctgcaatacccaaaacagtatggtacagatcgaacaatggaatagaataggtagcccagaaataatgtcacacacctatgaccatctgatctttgacaaaattaacaaaaacaaacgatctagaaaggacttactattcaataaatggtgctgggatagctggctagccataagcagagataattgaaactgggccccttccttacaccatatacaaaaattaactcaaggtggattaaatccttaaatttaaaacccaaaactataaaaacccttgaggaaaatctaggaaataccattctagacatagaccctggaaaaaaatttatgacagagacatgaaaagcaattgcaacaaaaacaaaaattgacaaatgggacctaattaaactaaagagctcctgcatagcaaaacagcaaaagaagctatcaacagagtaaacagacaacccaaagaatggagaaaatatttgcaaacaatgtatctgacaaagatatatccagtatctataagaaacttaaacaaatatacaagcaaaaaaacaagcaaccccattaaagagtgggcaaaggacataaacagacacttttcaaaagaagacatatacatgagcagtaagcacatgaaaaaatgctcagcatcactgatcattagagaaatataaatcaaaactaaatgagataccatctcacaccagtcagaatggctattactaaaaaaatcaaaaaataagagatgctggtgaaattgtggagaaaaaggaacacttatatacttctggtgggagtgtaaattagtccagccattgtggaaagcagtgcggtgattcctcaaagaacttaaagcagaattagcatgcaacccagcaatctcattattgggtatatacacaaaagaatataaattgttctaccataaagacacatgcacatgtatgttcatggcagcactcttcacaatagcaaagatgtggaatcagcctagatgaccatcaacggtagactggataaagaaaatgtacgtacatgtcatggaatactatgcagcacagtagactggataaagaaaatgtacatacatgtcatggaataatatgcagccataaaaaagaatgagatcatgttctttgcagcaacatggatggacctggaggctgtaatcccaagcaaactaatgcagggacagaaaaccaaatgctacatcttctcacttataagtgggagctacacattgaatacatatggacacaaagaggggaacaatagacaccagggccttcttgcgagtggagagtgggaggagggtgaagatcaaaaaactacttattgggtactacgtttattacctgggtgatgaaataatatatacaccaaacccctgtgacacacagtttatctataggaccaacctgcacatgtaccccagaaactaaaataaaagtttaagaaatgactttgagccctgtttctgttggtactcttcatgtcatgggcattttagggaaaaaatataaaaattttagttaactctttgtcttacactgtatgccaaaatctataccagattaattgtagatttaaaaataaaaatgaaaccataaaagaactagaaaatatataaagagttacctataatatcacattagggaaggcctaagtaagcatgacactgaaggcagtaaccatataggaaaagattattaggtttaactacatgtaaggaaagcttttcacaccctttgacccaacagtgtcatttctaatgacacatcctaaaaaacctttggacaagtgtataaaaatgtacatatgtggggccgggtgcagtggctcacgcctgtaatcccagcactttgggaggccgaggcaggcggatcacgaggtcaggagatagagaccatcctggctaacacagtgaaaccccatctctactaaaaaaatacaaaaaattagccgggcgtggtggcgggtgcctgtagtcccagctactcgggaggctgagacaggagaatggcgtgaacccgggaggcagagtttgcagtgagccaagatcgcaccactacactccagcctgcgcgacagagcgagactccgtctcaaaaaaaaaaaaaaagtacatcattgtttataaatgtacataacatataaattgtttataaatgtacatataaattgtttataaaatgtacatataaattgcttataaacatacattgtttataaatgtacatcattgtttataatagtgaaaaactggacccaatctaaatatttatcaaagatgattaaacgctgatgcatccatattaaaaattacaatgtaaaaatgtagttattgacataaaaaaggttatcaaatgacatttttcatctgatcccattttgtaaaaatacctatttatatacatagaagacttctagatgtgcatgaaatgttagtagtgattatttgggggtgctttaataagctctttttccttttgctcctcttttgtatgtatatacgtatgtatgcatgcgtttatgtatgtgtaaggagtaggtatattttgtatgaaaataatagaagcttaaaaagattttaaaatttccatttctctcttttcacttgtggatttaagtcagaccttctccaggaagctatttgttccccttaagtggccagtataattcctgaagccactccctcatcttttgtatttccctattcaactgtaagttcttgaaggtagagttgtgagttgcgtttcattatttactgccttccatacacatactctgtaaggactggttggctggtgatggcctgatttcttcaaagtctgcttttgaagtctgatataacagtgcttacccttaaccagctgaaacggtcaaaaacttggtccgggccagcacacctttgcaaagagggcagggtagccataatggctgtcttcctactactctcctaggctgtggtggctagctggctgatagagctgagccctttctgtgtaaatctttccccaaacagctttcttgttcaagaaaaaggcgtttctcaggttgagtcgctgcctcatatcattaatgtctatgtagttgtgctttcctctcagaacttccaagcacattttcaagaactcgcaatgctgttaaaaaaaaaattcataaaggatgggtaacaaagaaagaagacaaagaactgggaggagaggagaggagaagagagaaggaaaagagaattgagattcatgaccttaagtacagcaggttgctccaatctaaaacatcccctggacataacaatagctactgttgcacatgaaattactttgccagaaaagtctacacagacattggtttttcaagggacctgtgaaagctctgatggccactctggcagccctccaggttagagactttactgatctctaatagggcctgctcttatagttagagatcattccacgtttgttgcaaatatcaaatgagatgataaatggaaatatgttttataaactataatattgaaatgcttggtgttccttttgtaagctcttgagggcactgacagtggtttaatgtataactgtgtcttcatggcagtttggaacagattttaaatacctgtatttaaagaaagtcaaatccgtatacagaatgaagagaatttatttcctagaagggaaaaaaaaaatgactgtctgggagcgacctaaactgtttggggagttgcggtcacctaactatgttagaaacaccttgggttttctaagtaccttcaattgattagaattattttccttagaagtaatttccaataaaatgcttgtgatttcactgccaatgaaatggttgacatgtcttattttattttattttattttattttatttatttatttatttttgagatggagtctcgctctgtcacccaggctggagtgtagagcgtgatcttggttcactgcaagctccacctcccaggttcacgccattctcctggctcagccttccaagtagctgggactacaggcgcccaccaccacgcccagctaattttttgtgtttttagtagagacgaggtttcactgtgttagccaggatggtcttgatctcctgacctcgtgatccacccgcctcggcctcccaaagtgctgggattacaggtgtgagccaccacccccggccgacatttcttttaaagtgtccattaacttatagtaaattacaatggaaatgcatgtggccctcaagagtgtattatggtcaaacttttaataagtaacaaattaaatcatgataaggaagtgactaaaagttaaacactgctgctctgctctttccatgaaaatgaccctttgctccttccaagttcaacacgagacttcatatcagattctcacctgaacgcatgactcttcaacctcaggacttgcagaattaatggaatgctgtcctaaggttgttgagttgtgcatttctgggcatttcatctctatggggaagtacccattccctcaccccaaagactgaagtagagagatttttctccctagggaagaatcttccttgaaacttttgtggcctcaggagtcagaagacagaatggggaggtttgatagttggatccttgccaaaagcctgacccttggctgtgagactccctcaaatttgcagtgtcttggggatccctcctagtgactatcttagaaaataaacattttctgttcatttccaatgacttaattatctattttatttttcttataggcccagttaaaaacaagaaaaagggtaagttcctgactttataaaattgctgtcttgtcatatattttctaaagttagaagaaaaaaatcaagagtgcgatttttgtattatattctttcagcattgtctgtctgttattttattcaatcatatgttatcttcttgagtattgtagtttctgaagaacaagaaatcattcttcagtgatgattcacctctttcattcttccttgttcttctccctgcccttctttttattcttttttttttttttttttttttttttttgagacggagtttcactcttgttgcccaggctggaatgtaatgatgcaatcttagctcactgaaacctccacctttggggttcaagcgattctcttgcctcagcctcctgagtagctgggattacaggcactcgcttttatcctttttttcctcctttatcaaatcagtgattgagtgtgaatgaaatcctgtgtcaccatgtaggaactagatacgctacctatcaaaagatgtcagtaccctatttcttggacttaaagcttccctgatttgatttcccaaagagtcagggaaggtatttcttgctttgaggattcaatatcattttctctgtaatgaaaaagctattctggagtagtaccctgaccatttagtcttttcaaagcagcttccattgtgccgttgttgggtcagtaagtccccagtgtacttgcaatgaaactggccctagggcatctacaagtgctcacttactaaaagaggagaatcaatccaaagacagaacagtctccaaagacagggccaggcaatatggtctacttcttaggactgaaagaaccaattatgaaactagttaaagcacctgtttgtttctgggttctgacctgggaggaagacagagtaaaactaatgattgttcattaaaatgctttaagtgaaatgatgctgtgtgataagatttatggagctttatagaatagattgtcaaccccggactaggccaaaaagactggcttcagctgcagtctgccacttctttgaacactagggtactctggtgccttgaggtatcatagtccacatggaaaagttgtgtgcctgttgtaaagaagctgaggaatggcctggcctcctgagggcctgaactgagcaaggctggaaaacagccagggagctggagtcagtgaggaaacctttccctgtggggcctgggcacttaccaccaagatattctgtcttttaagaaagtagatttgattttcaaacatgtagttcttaactcttgtcatatccctttaaaacagaaattataactcagatcattgcctggcactgctaccttgtgtacgggacattattgagaagacagtgcacataggctttaaacatttactttggctgaaagttatttagaagccatttaatatggatttccttggacatggtgaataggcacatgcttgaagaggtaaattgaattgttctcttaattttcaccctttaatggaattttcctccttccacaactctctctcactcactcattcactcacttttggttgttctttgattttgggcttagctaaaaggttaaggaaatactcctttgatgaagtttagctttgaaaggaatgtgtatattctttcatctaacactacatagggtatgtttctaagtacaaacgtctctgggcttttatatcatgaggtgttctgttaaagtaaggaaatcgagagaagggagtcaatcctctgaagttatcctcttgctccaggggtcattttgtacattctcttctctgggcccaactttgtgtaagtatgcaagtgtgagaagctcacttgcctaacccttgttgcagagaagcagaggaccagctgcagaactggaacaaagcaggagtttttttttttctcaaatgccttctaacattttcataagtgaacattctctgttttcactgcaaccattagtctcttggactggaggagtttctggctctaattcttccaaaattacattagcaattacaggagactcacattcttgaaggtgaagtttgtgctacccacagaacaccctctagcttgaaaatcactgttaggcttggaaatcttggaacacaggacagcctaatatgcaccaacttctgtgtctgtgccacctagaaaataaggagggagaagcaaaccttacaaccaggctaagaaagcttcctgactgcaaggggtaagccacccctccttatagaaactcagtctcatgaggaaacagagaaatcattgaggccaagctccttgtttcacagatgtagaaactaaggctcaaggagaggaagggatttgcccaaagtgtgtctgtggcagagctggggcttacatccttatctcctgagtacagattttgtgttctttccactacactagctggaattgaaacttgggctctgaataagcctgatttggaagctgcccaaatctgaaaggagatggttttcctgttcagcatcttgaaattggctagatctagaaacggggcagatccaatcttttgctgctaagtgcagagaaacctctaaagctcatgcctctaggtctttaaggctacagggactcttctgggagagatgttctctggaccttcctttccttcctttctgaggaagagaccccacgatgaccccatggtttcattccaaatgcagatgtggttagacatagacaaatggcctcttgagtggcattgccatgaggattgggtttcttggccatgaggcattgttcttaagggaggacctgataaatcaggacaagattctcctgcctaagtgtctggggagcaagaagtcagagtcagtaagaaggtttttagtgagactagagaaggttgtatttaaaactaagaaactacctcaggtgaagacattgtgatgaagtctggaaacaggcttccattcctgaaactttccataaaattgtgagaaggtggtgaaggaaggaagaagacctgtgcctacatgtagtctttgagtggagctgcacagagcagaggaagtcaacaggaagagctggaggttttggttcaagaccacagttatgactcatttaagataactacatcctggtgggaatgttgaaaggactggaatatgaaataggagggtcgagattgttctagaaggatagcaaggaggaaagggggaagagttggtgggcatgattaataatacatttgagaatgggacttctgaggaaagactttgggaagctggattatttagcctatagaaataggggttggtgggtaacttaatttcttttcatatataaggattattatgtatatgtatattcttctctgtctacacaaatagaataagagcttaaactgccacaagagggacatcatttaatataccagagaacttcctaacagtgagcagtgaggggcaataaacattggaacatgttactatggagtttgcagaatttcctttcccagagatcttttaaaatagagtttacagaggtcagctgagagagtgaaacttgctgcctcctcctcagctccctctactctctgtctctgcttctttcctgtttctcaatatctctctctctccctcctcctctttccgtgcccctcttcctccttctccattcccccatctccaaaactccttcccattcctcattcccgactagcactgtccccatcccaacccccatttcctgtacatcctgactcctggaggaaccttcctggagctgatactgttcctaaggccaggctgtacggcttcctcttgttatcgacatcaagtccaccaaactgggcagtaaacataaaagctccacattcttcaacaatagccctttctaaaaagaaccacaaagtgacccataggtctaatcacttggtagagaaattctcatcctttggactcagctgaaatgtaacctcctttttgaaaccttctctgacctcttcagcatttggtccctacccactaaggtagcacttctactatcccatgactgtgtctgtttccccacagacacagactgatctcctggagggccacttatttctatatgctcaaacctagctttgtaaatgcatattcacaaaagggagtggggggaggggagagaaagcataagacagacggagacagggagacagagatgtgtgataaaggtatccaactctttagcagggcctcccagagagctgactttgtgtcctcagaagtctgtagaactcctgacagtacactcatcacaggaaataactacaaatgtaacactgaggccaggcgcggtggctcacgcctgtaatcccagcattttgggaggctgaggcaggcagatcacccgaagtcaggagtttgagaccaacctggccgacatggtgaaaccccgtctctactaaaaatacaaaaattagcaggtcgcggtggcacgcgcctgtaatcccagttactccagaggctgaggcaggagaatcgcttgaacccgggaggtggaggttgcagtgagccgagatcgtgccactgaactccagcctgggcaacagagcaggactccgtctcaaaaaaaaaagtaacactgaatcctatttttcaggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgagttcccctgtctctccaccccaccaggtgcctttaaagtactttaggagagcaggagtgggtgatcctgagagcagtttcaaacggtggagatggggttggtgtgcaataagggatgcagatctcctagcccagtgtaaaactaggaattggacaagccagtagggcctggcctgctctagcttcttatatctaccaaactgtcaaggacaggccacctgttcttgccccatctcaacccttctgttacaagccctccctgactcttggcctccctgtagtggaccagtaaaactcatatgagccagagacagaggccctggtggttcacaggagttccagtggggaatagatgtaatcttctgtgattcccagcatctagctccacatgctgatgtttgcatagaaataggctatggagtagaaagttgaggactgaacaaaatgacaagccctaggatagtttcatcttgtgaagtctgaagtgcttttcccatagcaagtagtcactaatggtcaagaagttagaaacttaagagtcactcaggctgtggatgaagcaaacccaggcaccaaggctgtcctgtccgggaaccaagtgcttcttgcactagatccttaccctaccacacttgccattcaaatgtcatttcatccctttgcatctttctccttaagccctgaagggcatccgaaaggtatgaatgcagatccaaacctgcctaattggagttgacaagagtcagactgcctgggctaatgtcagttgttatttctttctcctgctcctcactcccctgccctgtatcttggggctttaaagaaatggacccttacagctgatttctccaggggcaagaattctgcagcaggattcagattctttaacttgtacttcacacagggctcagcagtgttaccatggccacaagagatggagttagagattttttttcaaccaatcattccttaaatattgagcactttctgtatacaaagagatatattgatacatggtcccttttcttatagagtttatctcctagaggaagagagaacaaagaaacaagatatttacaaatagcagtgggctctatgaagaaaattaatagaaagggagcaaaacactagagaagccaatgccattgcctcagggtcacacagtgatgggaatgctctctcattgttctccatgggtgcccggtggggcttgccttgggctaatattggccagaggcaatactcagaagtttccctgctgggtgctgggcccactgaagatgaaggtcagggcaggaaacagaaggggtgcactctgactcttcctccagctctgagccctggagaataaagctcagacagggctggctgcagggagcatggctcaccaccactagctgctcaggtgaggggaaaaggaagtcaaaagattatgccctctgattgtcctatcctattttgcaggtgctgctgataaagctggaactcgagaaaaccaggttggctggggattgctctcttcctgggtaggagggaaagccacaggctagagccacctttaaattagcttcttattagatttcctgaggctttatttcatgagaacaccccggagattctgacggttttcactcacagccccctcccatctctatgaatagaaaagctttgccccagggcatgtttttagctaaggaaagggtgtcttgccaggatcatttttcctcattccacaggagaccccaggttcaccatagccaggcccagtagtcagctgaaataagctgccagtcagacctattcacctgagcctccaactccccaaccaccccagacaccttgccggctctcagaccacctgggatccggagctgaagagttgaagagtatgtccttgaaaaacagccaaccagctccaggcccagcctagcctgggcgtctgccttaatggcctgaagagctcctcccagtctttgagcttcctaatctgtctctattggcaggttctactgccttgccttgtctcatctcagcctcccttgctacagctgtgtggccacagtgataaatctacacagctgcacagtgcttgacggcttgcagggcaattttatatccatcacctcatttgatcttcagacatccctgtgagagaggccagacattcttataatccccattttacagttagggaaatgaggctcagaggcattacatttggttgaggtcacatagctaggaagcggtagagctacaaaatcatattaccctctagtagaaatgtagtcagtaacatcccaagacaggggagagggatcagaattggattacaatagaagactagaaaccaggatggaaacatgggactggtggctgagcaagcagccattactcatagtgactactctctatccttctcatcctgccagccagctgtggtgcatctacagggccaagggtcagcaattcaagtcaagaatggtaagaatcaaaataggctctctcccaaagaggagcttctcccctgcctcctccccagcctccaaataatcacccagcctagttcctcccaggccgctgaggtaccgttggcatacgaagtcattctttgctccatcatgccctctactggctgtcctgagcaattgctggcatcaagaccagttgctacacccaaattgctttagaatcactgatgacggagctgaaagggacttgagacatcatctagcccaggcattctcaggggatggaggttatatcagagccaccatggagatatgtgtagttagattaatattttcacaatacaaattatagaaagtaaaactatgtaaaattaaatttttcttgtctgatctacacaggtgggcagacaggctgcatctctcagggaaggtggggcatgttagaatctccagggaatttaagatgctagtgtctatcaaaaaggagaacatgtttaatggggttaagaaacactgatttgttgtaatccctgcatttaaaagatggggaaacagagtcccagagagattggataataccataataaatcatgctgtctcatatttgtacgatactttagagttctcagcatactttctttgtctttaatttcattcagtcctcacaaccaccctatgaggtaggtatgagctcctttttacaagacagaaagtgaagttcagagagattaattaagtttcccaatatttcttagtcaagttagtttaggagccaggattcaaaactacatctttctgactctttcctctcccctgtgctacttcagtgatatgtatgtacactccactgaatgattaggttcattttcttcccccaaagaaacatgaacattcatgaaagaacagcactttggaataatgtccagtccccagagtgcacaaagcctaaaatgcgtgaacccccaggagccttgggaagcagcaagctagccaagatgccagatgcttacagagcttggggtggaagggaggggttgtgagtacagaaacggtaaaggaaggttaaaaaaaacagctacatggggacagtttctaagaactcagtcagtcctgaactggctgtgctgagtttccttaatgactgtatttagctacttccctgactgccacctccatgtctgacttagtagcctcagaagtgtaaataggaacacaatggcaccaaaacccaattggtcctgctggggaccccaaggccctgagtgggccatgatccccacctgtccagggaggccagagacaggccaaaatagatttgtttggatatctagatggatagtgtttattctgtgctagcagccactgattttgctcccactgccacataataagattgtttccagcccctctgggccaatcctcagaggtggtctgtgctgacctttagtactaccagaagaagtgatgggggtggggtgcagtgactcacacctgtaatcccagcactttgggaggccgaggctggcggatcacatgaggccaaaagtttgagaccagcctggccaacatggtgaaaccccgtctccacaaaaaatacaaaaattagctgggcatagtggcacacacctgtaatcccagctgctcgggaggctgaggcaggagaatcacttgaacccgggaggtggaggttgcagtgagccaagatcacaccactgcactccagccttggtgacagagtgagtgacagtccatctcagaaaaaaaaaaaaaagaagaagaagtgatggggtcaggggttggaggacgtcatgcagagtggtccattgatgggacagagccagggcagctcctagcccatctacttaccacctcaaggaaagatggtcaccttttccagaaaggctgtttcctcacccctcagacaggcaggcctactgaaactggccaaagatggacttataaaatataatttcttgggtgcaggatggatggcttagaggggaaaaggctccctgggcttggatgtcctcctctcatggtgggaaggaacattcctctttctgcaggatggaaagagaagtttttcctccatcctcacacactggcttccgctgtccaaaggagtgtgactgccccctccacccctgcctggggtggggctgagacagatgctttgccaagggtggctcggctcctatcctcccagctggctctattgcagcctgccagtctatccttcactctcataaggatccctctcacctatggggccctggtactagtggtcagtagccccagttaccatggagtctgaatcatctctaatccctaaggttctccagatagacagtgggctgagtggtttcctcccagggaggctttccagaaagctgtgggtgtggaagaaccgtaaaaaagaatctcttaaggagaaagagaaaacccatgaacctatgagatgagagggattcaggagctctggctgggaaagtaaaattgaataataagacctagcctgccactcagtgtctgaattttgcctgtgcaggccccataacaacaaagaaaatagggcagcatgcccactctcatcctccaccggcaaattccagctagaaggtattggttaaagacccttccagatgcaagggtcaagaaaggaaggataaagacagacaggcagagcccaggagccctgaagcaggcctggcagctgctttacaaacagaacagcttctctgctttcaaatgctcttcttaaagtttggccttctaggctaccctggttgcactgggataggggtgggggttgtgaactccttggtatttattttctgttgcctcgattattctgacatgtactgagtgactgcccttctctcatactgagatctttcaggtggagtgctcaatgactggtctcgcatcactatgaaccccaaggtgtttaagctacatccccgcagcggggagctggaggtactggtggacggcacctacttcatctatagtcaggtagaagtgagtacggtcttaggcctaactcttcttatatccagaatgcagatccggtgcaggccacataggggcactgtggagccagccaagaccatccaatggctaacttcctgctttgggtgagggggtggggggaccgcactgggagggagttgaaaggaggaaagagagagggggccagcttcttttgttttgttttgttttgtttttccttagccaaatattattgaaaaactgtgaaaaagacccctcccacaccctgccatctgattccctcctgcagggcctcaggcccctgtttaccctctgagctgtttggctgcactgccaaacttgaacttggtctcagtacattctttgaaagtcagttccagggttactgagaaccctttccctcaacactgctggctcggacgttgtaatgaatagtgctcctgcagactttctttccacctcaaaaagatttctgactgtctttccttcctctttctcccatttgtttccctatctttctattcctctattcttgcctccttcctgctgtcattctcccagccctttctccctctgcttttgtcctcttcctgccctgggcccgctccccaagtccaccagtgtccatctacttccgttcccccattgtttgcctccatgggagtggctccttggagataaaggaagatgagccatgaggttgggatttttgtgggatgggcagcaagcaggcaggtggacagaaggactatggagccaacagatgggtgtcacatgagagcggccagagaaggtgggctaacaagcatctgctaggcacactgagcaccccgctgtagcttgggtcctgacccgtatatggcacccaaatatgctgttcccacctgaagagctgatagagggagtgacctttcataaaatgatttacggtgatatctgagagtcccaacacccatggggcacatgggcataaccctgatgtcctgtgagccaagttccacgtggtgggggtgggcggcagatcaaaacttggtgtgaggtatgatggataagggtagtgaaggatggaaaaattaattttctgagcctaggagagaattgagagtggcccatgcaggctgggaaaatccccatgacattaggccactgagcataagttagtgcttccttctggccacaaagttaggggcctgggcttttccaaattctttgtcttgtttgtggtagctagctctcgatctctctggacctgtttcctcaatcatcagatgggaggcccaaggggcactgtgaatcagtgaggggagtccaggcccaggggaggggtggtgcaagctgaataagcttctgttaaggagctcaagaaatcacaagttgttacatgccctctctggggaatcagtgacttctaagtttctccacaaatagtccgtggggctcaagaatggaagtcagtttgtgtccacggcactgtgtacacacctgctacgtgcagagcactctgcttcatgtcagggctggggcaggggtgggcgggggaacaggggcacggtgaagctgcaaatagggcatggttcttagccttacagagtttgcgacaagtgtgctgttgtaagaaaagtttgctcagccagctgagccccatggactaggggaagaacaatgcctgtcacctgtcctttcctgttggccagctagcacgccttcacatggcactgccccatccatggggtatactaacagctcatctgagaagattctgtcaattcaccacagggagggccccccaccctctctttcctctcttccccaatcccttcttgttgcctctcactcaggtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacaaacagaattttccatttattaagcagtacaaatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctggcctagaaagggcaaggggtgaggataggacagagggattttgttcaagtttgctgcaacccaagtggacgttaggccaggccttatctgaaaggccagcagctgatgctgtactaacccagtctttcttcactctggcttcaaaaagccacagcagagcattgtcaccgcaggtgctcatgctgctcccctaaagccaggctcaggagaagccagtgtctaggcactgagcagggatctgccccctagttcaggtccaaattcaccttcccctaaaccccaagcttcccaacagatcatatggtaggaccctcgagagccttacttcaaagtgcctgggctcagcctggtttctgggtgctagatccagcccaaacctgggaaggccagccttgtacagtctgctcctcttgttcctgaaatgtgtttccttttcaggagatggggaataatttccttcaggcagctgaaattcaccaagaacagcgggtacttatttctcagctgtgccttccctttctaagcaaccacactgcttggcccttcaagggtcagggtgagacgtgatgggctaggcctccgttgtctggttgctaatgacagccttgcaacccaaggtgaggtgaactccaggcatgtgtctggccctaactcctataaagtgcctcggacagtccgcagttgtagcagaaaccaacaagaaccactccttcatgtttggaaaataatttctcttgtattatctcctttgaagaaggcaaggctgataatatgacaaacatcattgtttagatgaggctcagagaggtagcactctcagagtgttttgaccagtttaagccgcagacctggagcttcagccaggtctgactccaaagctgttccattacaccacagcattgtgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctagagggcgagggatgatgagggaagcaataggtagctggggagccctattgctgctaagtcattggcaaagtgacaaagcaatttactgatgagagaatgtggaaatagatgtgcagtttggaattatgttggtgtgaatttgccagaggaccaatgcttgcatggagaatgggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatccatgtatgagtgtatgtgtttatgtaacttcctgtggatgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccacccacaaactccaggctggaagtacttggcccccttcaggagcctggccaggcagggagagagtagctgcagccttcatcagaactcttcctcctcccaaggcattctcccagctctagcctctggactggaaagcacaagactggcccagtgccagcaagtccttaggctactgtaatgctgcctcaggacccatccctgcctggaggctcctctaggccctgtgagcacaaagaagaaagctgatttttgtcttttaatccatttcaggactctctccaggagggctcggggtgtgtcatttctatattcctccagctgggattggggggtgggctttgttgtgagaatggcctggagcaggcccaatgctgcttttgggggtcagcatccagtgtgagatactgtgtatataaactatatataatgtatataaactgggatgtaagtttgtgtaaattaatggtttattctttgcaaataaaacgctttccccgtctgtt
